United States Patent
Mendez et al.

(10) Patent No.: US 10,894,952 B2
(45) Date of Patent: Jan. 19, 2021

(54) COMPOSITIONS AND METHODS FOR USING GENETICALLY MODIFIED ENZYMES

(71) Applicant: Renew Biopharma, Inc., San Diego, CA (US)

(72) Inventors: Michael Mendez, San Diego, CA (US); Joseph Noel, San Diego, CA (US); Michael Burkart, San Diego, CA (US); Jeremy Lanoiselee, San Diego, CA (US); Kyle Botsch, La Mesa, CA (US); Matthew Saunders, San Diego, CA (US)

(73) Assignee: RENEW BIOPHARMA, INC., San Diego, CA (US)

( * ) Notice: Subject to any disclaimer, the term of this patent is extended or adjusted under 35 U.S.C. 154(b) by 0 days.

(21) Appl. No.: 16/682,845

(22) Filed: Nov. 13, 2019

(65) Prior Publication Data

US 2020/0123511 A1    Apr. 23, 2020

Related U.S. Application Data

(63) Continuation of application No. PCT/US2019/023046, filed on Mar. 19, 2019.

(60) Provisional application No. 62/645,081, filed on Mar. 19, 2018.

(51) Int. Cl.
*C12N 9/10* (2006.01)
*C12P 7/42* (2006.01)

(52) U.S. Cl.
CPC .............. *C12N 9/1085* (2013.01); *C12P 7/42* (2013.01); *C12Y 205/01001* (2013.01)

(58) Field of Classification Search
None
See application file for complete search history.

(56) References Cited

U.S. PATENT DOCUMENTS

| 7,361,483 B2 | 4/2008 | Kuzuyama et al. |
| 7,544,498 B2 | 6/2009 | Kuzuyama et al. |
| 8,124,390 B2 | 2/2012 | Kuzuyama et al. |

FOREIGN PATENT DOCUMENTS

| WO | WO 2006/081537 A2 | 8/2006 |
| WO | WO 2019/173770 A1 | 9/2019 |

OTHER PUBLICATIONS

Kuzuyama et al Structural basis for the promiscuous biosynthetic prenylation of aromatic natural products, Nature vol. 435116 Jun. 2005 (Year: 2005).*
Vickery, "Posttranslational modification of natural product biosynthetic enzymes in bacteria and plants," Ph.D. Thesis, University of California, San Diego, 2016, 185 pages, retrieved from https://escholarship.org/uc/item/02s8d2zp.
GenBank Accession No. AB187169.1, "*Streptomyces* sp. CL190 gene for prenyltransferase, complete cds," Oct. 29, 2015, retrieved from https://www.ncbi.nlm.nih.gov/nuccore/AB187169.1?from=1 &to=924, 2 pages.
International Search Report and Written Opinion of the International Searching Authority for International Application No. PCT/US2019/023046, dated Aug. 19, 2019.
Schreckenbach, "Enzymatische Oligomerisierung von Alkendiphosphaten," Ph.D. Thesis, Mar. 22, 2017, 71 pages, retrieved from https://d-nb.info/1137206578/34.

* cited by examiner

*Primary Examiner* — Kagnew H Gebreyesus
(74) *Attorney, Agent, or Firm* — Cooley LLP

(57) ABSTRACT

The disclosure relates to the biosynthesis of cannabinoids and related prenylated phenolic compounds using recombinant enzymes. In particular, the disclosure provides recombinant mutant ORF2 enzymes engineered to produce a greater amount of a desired product, or to have a greater ability to catalyze a reaction using a desired substrate, as compared to WT ORF2. The disclosure also provides methods of preparing such ORF2 mutant enzymes; as well as methods of use thereof in improving the biosynthesis of cannabinoids and related prenylated phenolic compounds.

26 Claims, 125 Drawing Sheets

Specification includes a Sequence Listing.

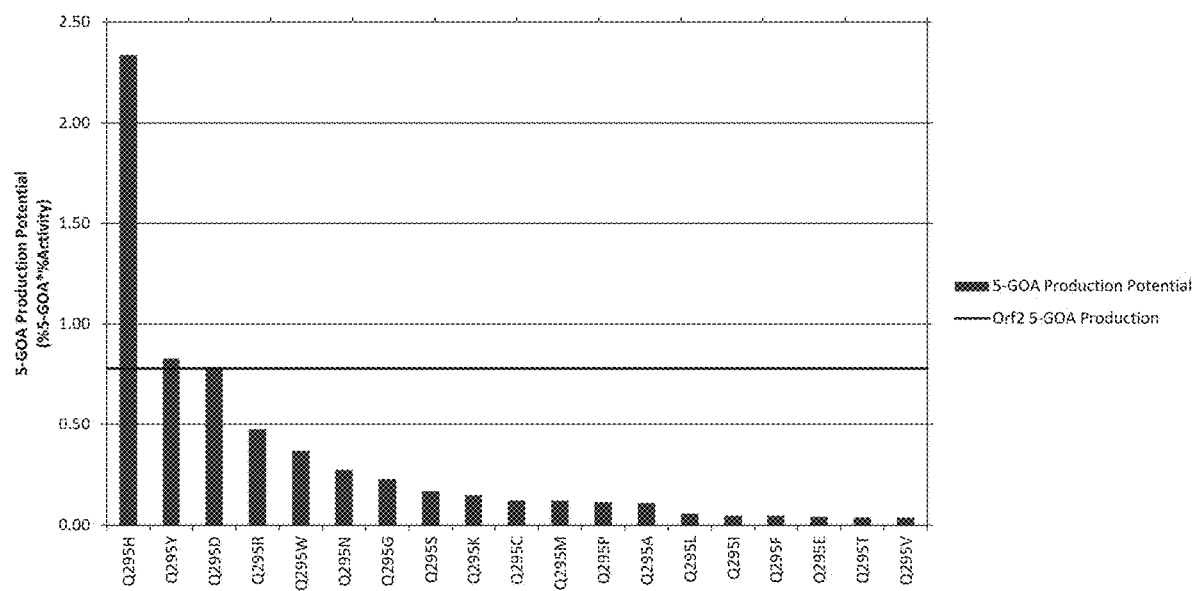

FIG. 36A

Clone A04 Break Down (#16 for CBGVA Production)

FIG. 36B

A04 Break Down (#16 for CBGVA Production) %CBGVA in Total Major Prenylated Products

FIG. 46

CBGVA Production potential of Stacking Variants

FIG. 100. Analysis of enzymatic activity of site-saturated ORF2 mutants of Y288 using DVA as substrate and GPP as donor

FIG. 103A

Clone G12 Single Break Down (#1 for CBGVA Production)

FIG. 103B

G12 Single Break Down (#1 for CBGVA Production) %CBGVA in Total Major Prenylated Products benzoic acids                                                benzenediols The R group can be substituted by any alkenyl, alkynyl or cyclic substiuent that anyone skilled in the art would recognize as appropriate for diversification using a medicinal chemistry approach.

Apigenin

Resveratrol

Naringenin

Tri Acetic Acid Lactone

Flavone 1,6 DHN

COMPOSITIONS AND METHODS FOR USING GENETICALLY MODIFIED ENZYMES

CROSS REFERENCE TO RELATED APPLICATIONS

This application is a continuation application of the International Application No. PCT/US2019/023046, filed Mar. 19, 2019, which claims the benefit of priority under 35 U.S.C. § 119(e) of U.S. Provisional Patent Application No. 62/645,081, the disclosure of each of which is incorporated herein by reference in their entireties for all purposes.

INCORPORATION BY REFERENCE OF SEQUENCE LISTING

The contents of the text file named "REBI_001_01US_SeqList_ST25.txt", which was created on Nov. 12, 2019 and is 1,190 megabytes in size, are hereby incorporated by reference in its entirety.

TECHNICAL FIELD

The present disclosure is generally related to the biosynthesis of organic compounds, such as cannabinoids, using recombinant enzymes.

BACKGROUND

Cannabinoids include a group of more than 100 chemical compounds mainly found in the plant *Cannabis sativa* L. Due to the unique interaction of cannabinoids with the human endocannabinoid system, many of these compounds are potential therapeutic agents for the treatment of several medical conditions. For instance, the psychoactive compound $\Delta^9$-tetrahydrocannabinol ($\Delta^9$-THC) has been used in the treatment of pain and other medical conditions. Several synthetic *Cannabis*-based preparations have been used in the USA, Canada and other countries as an authorized treatment for nausea and vomiting in cancer chemotherapy, appetite loss in acquired immune deficiency syndrome and symptomatic relief of neuropathic pain in multiple sclerosis.

Cannabinoids are terpenophenolic compounds, produced from fatty acids and isoprenoid precursors as part of the secondary metabolism of *Cannabis*. The main cannabinoids produced by *Cannabis* are $\Delta^9$-tetrahydrocannabidiol (THC), cannabidiol (CBD) and cannabinol (CBN), followed by cannabigerol (CBG), cannabichromene (CBC) and other minor constituents. Currently, $\Delta^9$-THC and CBD are either extracted from the plant or chemically synthesized. However, agricultural production of cannabinoids faces challenges such as plant susceptibility to climate and diseases, low content of less-abundant cannabinoids, and need for extraction of cannabinoids by chemical processing. Furthermore, chemical synthesis of cannabinoids has failed to be a cost-effective alternative mainly because of complex synthesis leading to high production cost and low yields.

Therefore, there is a pressing need for biotechnology-based synthetic biology approaches which can enable the synthesis of high-quality cannabinoids in a cost-effective and environmentally friendly manner.

SUMMARY

In one aspect, the disclosure provides a recombinant polypeptide comprising an amino acid sequence with at least 95% identity to SEQ ID NO: 1, wherein said amino acid sequence comprises at least one amino acid substitution to SEQ ID NO: 1, wherein said at least one amino acid substitution does not comprise an alanine substitution at a position selected from the group consisting of amino acid positions 47, 64, 110, 121, 123, 126, 161, 175, 177, 214, 216, 288, 294, and 295.

In one aspect, the disclosure provides a recombinant polypeptide comprising an amino acid sequence with at least 95% identity to SEQ ID NO: 1, wherein said amino acid sequence comprises at least one amino acid substitution to SEQ ID NO: 1, wherein at least one of said at least one amino acid substitution to SEQ ID NO: 1 is located on a position chosen from the group consisting of amino acid positions 1-46, 48-63, 65-109, 111-120, 122, 124, 125, 127-160, 162-174, 176, 178-213, 215, 217-287, 289-293, and 296-307.

In some cases, the amino acid sequence has at least 96%, 97%, 98%, or 99% sequence identity to SEQ ID NO: 1. In some cases, the at least one amino acid substitution comprises 1, 2, 3, 4, 5, 6, 7, 8, 9, 10, 11, 12, 13, 14, or 15 amino acid substitutions to SEQ ID NO: 1. In some cases, said at least one of said at least one amino acid substitution is located on a position chosen from the group consisting of amino acid positions 17, 25, 38, 49, 53, 106, 108, 112, 118, 119, 121, 123, 161, 162, 166, 173, 174, 177, 205, 209, 213, 214, 216, 219, 227, 228, 230, 232, 271, 274, 283, 286, 288, 294, 295, and 298. In some cases, said at least one of said at least one amino acid substitution is located on a position chosen from the group consisting of amino acid positions 17, 25, 38, 49, 53, 106, 108, 112, 118, 119, 162, 166, 173, 174, 205, 209, 213, 219, 227, 228, 230, 232, 271, 274, 283, 286, 288, and 298.

In some cases, said at least one of said at least one amino acid substitution is chosen from the group consisting of A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W.

In some cases, said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a ratio of an amount of CBGA to a combined amount of CBGA and 5-GOA that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295F, Q295L, Q295V, Q295I, Q295M, Q295E, Q295C, Q295W, Q295G, Q295T, Q295P, Q295S, Q295D, Q295N, Q295K, and Q295Y. In some cases, said amino acid sequence is selected from the group consisting of SEQ ID NOs: 139-143; 145-150; and 153-157. In some cases, said at least one amino acid substitution to SEQ ID NO: 1 is selected from the group consisting of Q161H, Q161Y, Q161R, Q161D, Q161F, Q161K, Q161M, Q161E, Q161L, Q161S, Q161T, Q161N, and Q161I. In some cases, said amino acid sequence is selected from the group consisting of SEQ ID NOs: 120-122; 124-129; 132-134; and 137. In some cases, said at least one amino acid substitution to SEQ ID NO: 1 is selected from the group consisting of S214H, S214R, S214Q, S214E, S214K, S214M, S214I, S214L, S214N, S214D, S214Y, S214F, and S214T. In some cases, said amino acid sequence is selected from the group consisting of SEQ ID NOs: 160-162; 164-169; 171, 172, 174, and 177. In some cases, said at least one amino acid substitution to SEQ ID NO: 1 is selected from the group consisting of Y288F, Y288P, Y288A, Y288L, Y288C, Y288I, Y288M, Y288G, Y288T, Y288S, Y288W, Y288D, Y288E, Y288N, Y288K, Y288R, and Y288H. In some cases, said amino acid sequence is selected from the group consisting of SEQ ID NOs: 98-110; 112-114; and 116.

In some cases, said at least one amino acid substitution to SEQ ID NO: 1 comprises two or more amino acid substitutions to SEQ ID NO: 1 selected from the group consisting of (a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T and S214R; S177W and Q295A; S214R and Q295F; Q161S and S214R; S177W and S214R; Q161S and Q295L; Q161S and Q295F; V49A and S214R; A53T and Q295F; Q161S and S177W; Q161S, V294A and Q295W; A53T, Q161S and Q295W; A53T and S177W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A. In some cases, said amino acid sequence is selected from the group consisting of SEQ ID NOs: 275-294; and 296-299.

In some cases, said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a ratio of an amount of 5-GOA to a combined amount of CBGA and 5-GOA that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H and Q295R. In some cases, said amino acid sequence is selected from the group consisting of SEQ ID NOs: 144 and 152. In some cases, said at least one amino acid substitution to SEQ ID NO: 1 is selected from the group consisting of Q161W, Q161G, Q161V, Q161C, and Q161P. In some cases, said amino acid sequence is selected from the group consisting of SEQ ID NOs: 118, 119, 123, 130, 131, 135, and 136. In some cases, said at least one amino acid substitution to SEQ ID NO: 1 is selected from the group consisting of S214V, S214C, S214W, S214P, S214A, and S214G. In some cases, said amino acid sequence is selected from the group consisting of SEQ ID NOs: 159, 163, 170, 175 and 176. In some cases, said at least one amino acid substitution to SEQ ID NO: 1 is selected from the group consisting of A53T and Q161S; A53T, Q161S and V294A; A53T, Q161S and V294N; A53T and V294A; and V49A and Q161S. In some cases, said amino acid sequence is selected from the group consisting of SEQ ID NOs: 272-274, 295, and 300.

In some cases, said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a combined amount of CBGA and 5-GOA that is higher than wild-type ORF2 enzyme under the same condition. In some cases, said combined amount is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H, Q295F, Q295W, Q295M, Q295D, Q295L, and Q295Y. In some cases, said amino acid sequence is selected from the group consisting of SEQ ID NOs: 140, 142, 144, 147, 148, 156 and 157. In some cases, said at least one amino acid substitution to SEQ ID NO: 1 is selected from the group consisting of Q161H, Q161Y, Q161L, Q161R, Q161C, Q161T, Q161S, Q161F, Q161I, and Q161P. In some cases, said amino acid sequence is selected from the group consisting of SEQ ID NOs: 119, 122, 124, 125, 127, 130, 132-134, and 137. In some cases, said at least one amino acid substitution to SEQ ID NO: 1 is selected from the group consisting of S214G and S214H. In some cases, said amino acid sequence is selected from the group consisting of SEQ ID NOs: 163 and 164. In some cases, said at least one amino acid substitution to SEQ ID NO: 1 is selected from the group consisting of Y288L, Y288P, Y288I, Y288A, Y288F, Y288C, Y288M, and Y288T. In some cases, said amino acid sequence is selected from the group consisting of SEQ ID NOs: 98, 99, 102, 105, 107, 108, 110, and 114.

In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F,

D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T and V294A; A53T, Q161S and V294A; A53T, Q161S and V294N; Q161S, V294A and Q295A; A53T, Q161S and Q295A; A53T, Q161S, V294A and Q295A; A53T, Q161S, V294N and Q295A; A53T and Q295W; Q161S, V294A and Q295W; A53T, Q161S and Q295W; A53T, V294A and Q295W; A53T, Q161S, V294A and Q295W; A53T, Q161S, V294N and Q295W; S177W and Q295A; A53T and S177W; A53T and Q295F; A53T and S214R; A53T and Q161S; Q161S and Q295F; Q161S and Q295L; and S214R and Q295F. In some cases, said amino acid sequence is selected from the group consisting of SEQ ID NOs: 272-274, 276, 277, 279-287; 290, 293-297, and 299.

In some cases, said recombinant polypeptide converts olivetolic acid (OA) and geranyl diphosphate (GPP) to cannabigerolic acid (CBGA) and 5-geranyl olivetolate (5-GOA), and wherein said recombinant polypeptide has a CBGA production potential that is higher than wild-type ORF2 enzyme under the same condition. In some cases, said CBGA production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295F, Q295M, Q295W, Q295L, Q295I, Q295C, Q295G, Q295V, Q295D, and Q295H. In some cases, said amino acid sequence is selected from the group consisting of SEQ ID NOs: 139, 140, 142-145, 147, 148, 155 and 156. In some cases, said at least one amino acid substitution to SEQ ID NO: 1 is selected from the group consisting of Q161H, Q161Y, Q161R, Q161F, Q161L, Q161S, Q161T, Q161I, Q161M, and Q161K. In some cases, said amino acid sequence is selected from the group consisting of SEQ ID NOs: 122, 124-128, 132-134, and 137. In some cases, said at least one amino acid substitution to SEQ ID NO: 1 is selected from the group consisting of S214H, S214Q, and S214R. In some cases, said amino acid sequence is selected from the group consisting of SEQ ID NOs: 164, 171 and 172. In some cases, said at least one amino acid substitution to SEQ ID NO: 1 is selected from the group consisting of Y288L, Y288P, Y288I, Y288A, Y288F, Y288C, Y288M, and Y288T. In some cases, said amino acid sequence is selected from the group consisting of SEQ ID NOs: 98, 99, 102, 105, 107, 108, 110 and 114. In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53 T_Q161 S_V294A; A53 T_Q161 S_V294N; A53 T_Q295A; Q161S_V294A_Q295A; A53 T_Q161S_Q295A; A53T_V294A_Q295A; A53T_Q161S_V294A_Q295A; A53T_Q161S_V294N Q295A; A53T_Q295W; Q161S_V294A_Q295W; A53 T_Q161S_Q295W; A53T_V294A_Q295W; A53T_Q161S_V294A_Q295W; A53T_Q161S_V294N Q295W; S177W_Q295A; S177W_S214R; Q161S_S177W; A53T_S177W; V49A S214R; A53T_Q295F; A53T_S214R; A53T_Q161S; Q161S_Q295F; Q161S_Q295L; Q161S_S214R; and S214R_Q295F. In some cases, said amino acid sequence is selected from the group consisting of SEQ ID NOs: 273-290, and 292-299.

In some cases, said recombinant polypeptide converts olivetolic acid (OA) and geranyl diphosphate (GPP) to cannabigerolic acid (CBGA) and 5-geranyl olivetolate (5-GOA), and wherein said recombinant polypeptide has a 5-GOA production potential that is higher than wild-type ORF2 enzyme under the same condition. In some cases, said 5-GOA production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H and Q295Y. In some cases, said amino acid sequence is selected from the group consisting of SEQ ID NOs: 144 and 157. In some cases, said at least one amino acid substitution to SEQ ID NO: 1 is selected from the group consisting of Q161C, Q161L, Q161T, Q161P, Q161I, and Q161S. In some cases, said amino acid sequence is selected from the group consisting of SEQ ID NOs: 119, 125, 127, 130, 133 and 134. In some cases, said at least one amino acid substitution to SEQ ID NO: 1 is S214G. In some cases, said amino acid sequence is SEQ ID NO: 163. In some cases, said at least one amino acid substitution to SEQ ID NO: 1 is selected from the group consisting of A53T_V294A; V49A_Q295L; and V49A_Q161S. In some cases, said amino acid sequence is selected from the group consisting of SEQ ID NOs: 272, 291, and 300.

In some cases, said recombinant polypeptide converts DVA and geranyl diphosphate (GPP) to CBGVA and 5-GDVA, and wherein said recombinant polypeptide produces a ratio of an amount of CBGVA to a combined amount of CBGVA and 5-GDVA that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295F, Q295I, Q295W, Q295V, Q295M, Q295L, Q295E, Q295H, Q295P, Q295C, Q295T and Q295Y. In some cases, said amino acid sequence is selected from the group consisting of SEQ ID NOs: 139, 141, 142, 144, 145, 147, 148, 150, 154, 155, 156, and 157. In some cases, said at least one amino acid substitution to SEQ ID NO: 1 is selected from the group consisting of Q161H, Q161Y, Q161R, Q161K, Q161E, Q161S, Q161D, Q161F, Q161T, Q161G, and Q161P. In some cases, said amino acid sequence is selected from the group consisting of SEQ ID NOs: 120, 121, 122, 123, 124, 126, 130, 132, 133, 134, and 137. In some cases, said at least one amino acid substitution to SEQ ID NO: 1 is selected from the group consisting of S214R, S214H, S214K, S214E, S214Q, S214L, S214M, S214Y, S214I, S214F, S214D, S214N, S214G, S214T, and S214V. In some cases, said amino acid sequence is selected from the group consisting of SEQ ID NOs: 160, 161, 162, 163, 164, 165, 166, 167, 168, 169, 171, 172, 174, 175, and 177. In some cases, said at least one amino acid substitution to SEQ ID NO: 1 is selected from the group consisting of Y288F, Y288I, Y288L, Y288M, Y288P, Y288T, Y288W, Y288C, and Y288G. In some cases, said amino acid sequence is selected from the group consisting of SEQ ID NOs: 99, 102, 103, 105, 107, 108, 110, 114, and 116.

In some cases, said at least one amino acid substitution to SEQ ID NO: 1 comprises two or more amino acid substitution to SEQ ID NO: 1 selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T_S214R, Q161S_Q295L, S177W_Q295A, Q161S_Q295F, A53T_Q295F, S214R_Q295F, Q161S_S177W, Q16S_S214R, A53T_Q161S, A53T_V294A, A53T_S177W, A53T_Q161S_V294A_Q295W, A53T_V294A_Q295W, A53T_Q161S_V294N Q295W, A53T_Q161S_V294A, A53T_Q295W, A53T_Q161S_V294N, Q161S_V294A_Q295A, A53T_Q161S_V294A_Q295A, A53T_Q161S_Q295W, A53T_Q161S_V294N Q295A, A53T_Q161S_Q295A, A53T_Q295A, S177W_S214R, A53T_V294A_Q295A, Q161S_V294A_Q295W V49A S214R, and V49A_Q295L. In some cases, said amino acid sequence is selected from the group consisting of SEQ ID NOs: 275-294; and 296-299.

In some cases, said recombinant polypeptide converts DVA and geranyl diphosphate (GPP) to CBGVA and 5-GDVA, and wherein said recombinant polypeptide produces a ratio of an amount of 5-GDVA to a combined amount of CBGVA and 5-GDVA that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295G, Q295D, Q295S, Q295N, Q295K, and Q295R. In some cases, said amino acid sequence is selected from the group consisting of SEQ ID NOs: 140, 143, 146, 149, 153, and 153. In some cases, said at least one amino acid substitution to SEQ ID NO: 1 is selected from the group consisting of Q161V, Q161L, Q161I, Q161M, Q161W, and Q161C. In some cases, said amino acid sequence is selected from the group consisting of SEQ ID NOs: 119, 125, 127, 128, 135, and 136. In some cases, said at least one amino acid substitution to SEQ ID NO: 1 is selected from the group consisting of S214W, S214P, and S214C. In some cases, said amino acid sequence is selected from the group consisting of SEQ ID NOs: 159, 170, and 176. In some cases, said at least one amino acid substitution to SEQ ID NO: 1 is selected from the group consisting of Y288H, Y288S, Y288N, Y288K, Y288D, Y288R, and Y288E. In some cases, said amino acid sequence is selected from the group consisting of SEQ ID NOs: 100, 101, 104, 106, 109, 112, and 113.

In some cases, said recombinant polypeptide converts DVA and geranyl diphosphate (GPP) to CBGVA and 5-GDVA, and wherein said recombinant polypeptide produces a combined amount of CBGVA and 5-GDVA that is higher than wild-type ORF2 enzyme under the same condition. In some cases, said combined amount is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295D, Q295F, and Q295Y. In some cases, said amino acid sequence is selected from the group consisting of SEQ ID NOs: 140, 142, and 157. In some cases, said at least one amino acid substitution to SEQ ID NO: 1 is selected from the group consisting of Q161H, Q161C, Q161M, Q161R, Q161F, Q161T, Q161S, Q161Y, Q161L, and Q161I. In some cases, said amino acid sequence is selected from the group consisting of SEQ ID NOs: 119, 122, 124, 125, 127, 128, 132, 133, 134, and 137. In some cases, said at least one amino acid substitution to SEQ ID NO: 1 is selected from the group consisting of S214R and S214H. In some cases, said amino acid sequence is selected from the group consisting of SEQ ID NOs: 164 and 172. In some cases, said at least one amino acid substitution to SEQ ID NO: 1 is selected from the group consisting of Y288F, Y288I, Y288L, Y288M, Y288P, Y288T, and Y288W. In some cases, said amino acid sequence is selected from the group consisting of SEQ ID NOs: 102, 105, 107, 108, 110, 114, and 116.

In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A,

Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T_S214R, Q161S_Q295L, S177W_Q295A, Q161S_Q295F, A53T_Q295F, S214R_Q295F, Q161S_S177W, Q161S_S214R, A53T_Q161S, and A53T_V294A. In some cases, said amino acid sequence is selected from the group consisting of SEQ ID NOs: 224, 272, 287, 289, 293, 294, 296, 297, 298, and 299.

In some cases, said recombinant polypeptide converts DVA and geranyl diphosphate (GPP) to CBGVA and 5-GDVA, and wherein said recombinant polypeptide has a CBGVA production potential that is higher than wild-type ORF2 enzyme under the same condition. In some cases, said CBGVA production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295F, Q295W, Q295H, Q295I, Q295M, Q295L, Q295Y, and Q295D. In some cases, said amino acid sequence is selected from the group consisting of SEQ ID NOs: 140, 142, 144, 145, 147, 148, 156, and 157. In some cases, said at least one amino acid substitution to SEQ ID NO: 1 is selected from the group consisting of Q161H, Q161R, Q161Y, Q161S, Q161F, Q161K, and Q161T. In some cases, said amino acid sequence is selected from the group consisting of SEQ ID NOs: 122, 124, 126, 132, 133, 134, and 137. In some cases, said at least one amino acid substitution to SEQ ID NO: 1 is selected from the group consisting of S214R, S214H, S214D, S214E, S214N, S214K, S214Q, and S214T. In some cases, said amino acid sequence is selected from the group consisting of SEQ ID NOs: 160, 161, 164, 166, 169, 171, 172, and 174. In some cases, said at least one amino acid substitution to SEQ ID NO: 1 is selected from the group consisting of Y288F, Y288I, Y288L, Y288M, Y288P, Y288T, Y288W, Y288C, and Y288G. In some cases, said amino acid sequence is selected from the group consisting of SEQ ID NOs: 99, 102, 103, 105, 107, 108, 110, 114, and 116.

In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T_S214R, S177W_Q295A, S214R_Q295F, Q16S_S214R, S177W_S214R, Q161S_Q295L, Q161S_Q295F, V49A S214R, A53T_Q295F, Q161S_S177W, Q161S_V294A_Q295A, A53T_Q161S_Q295W, A53T_S177W, A53T_V294A_Q295W, A53T_Q295W, Q161S_V294A_Q295W, V49A_Q295L, A53T_Q161S_V294A_Q295W A53T_Q161S_V294N Q295A, A53T_Q161S_Q295A, A53T_Q161S_V294A_Q295A A53T_Q161S_V294N Q295W, A53T_Q161S, A53T_Q161S_V294A, A53T_Q161S_V294N, and A53T_V294A_Q295A. In some cases, said amino acid sequence is selected from the group consisting of SEQ ID NOs: 272-274, 276-277, and 279-300.

In some cases, said recombinant polypeptide converts DVA and geranyl diphosphate (GPP) to CBGVA and 5-GDVA, and wherein said recombinant polypeptide has a 5-GDVA production potential that is higher than wild-type ORF2 enzyme under the same condition. In some cases, said 5-GDVA production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295D and Q295Y. In some cases, said amino acid sequence is selected from the group consisting of SEQ ID NOs: 140 and 157. In some cases, said at least one amino acid substitution to SEQ ID NO: 1 is selected from the group consisting of Q161C, Q161M, Q161T, Q161L, Q161F, and Q161I. In some cases, said amino acid sequence is selected from the group consisting of SEQ ID NOs: 119, 122, 125, 127, 128, and 134. In some cases, said at least one amino acid substitution to SEQ ID NO: 1 comprises two or more amino acid substitutions.

In some cases, said two or more amino acid substitutions are selected from the group consisting of: A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W.

In some cases, said two or more amino acid substitutions are selected from the group consisting of: Q161S_Q295F, A53T_Q295F, S214R_Q295F, Q161S_S177W, Q16S_S214R, A53T_S177W, A53T_V294A_Q295W, A53T_Q161S_V294A_Q295W, A53T_Q295W, Q161S_V294A_Q295A, A53T_Q161S_V294N Q295W, A53T_Q161S, A53T_Q161S_Q295W, S177W_S214R, A53T_Q161S_V294A_Q295A, A53T_Q161S_V294N Q295A, A53T_Q161S_Q295A, A53T_Q161S_V294A, Q161S_V294A_Q295W, and A53T_Q161S_V294N. In some cases, said amino acid sequence is selected from the group consisting of SEQ ID NOs: 273, 274, 276, 277, 279-290, and 293-300.

In some cases, said recombinant polypeptide converts Olivetol (O) and geranyl diphosphate (GPP) to CBG and 5-GO, and wherein said recombinant polypeptide produces a ratio of an amount of CBG to a combined amount of CBG and 5-GO that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295G, Q295M, Q295H, Q295F, Q295C, Q295L, and Q295S. In some cases, said amino acid sequence is selected from the group consisting of SEQ ID NOs: 139, 142, 143, 144, 147, 148, and 153. In some cases, said at least one amino acid substitution to SEQ ID NO: 1 is selected from the group consisting of Q161F, Q161Y, Q161L, Q161H, Q161M, Q161I, Q161C, Q161S, Q161T, Q161D, Q161G, Q161W, and Q161N. In some cases, said amino acid sequence is selected from the group consisting of SEQ ID NOs: 119, 120, 122, 123, 124, 125, 127, 128, 129, 133, 134, 136, and 137. In some cases, said at least one amino acid substitution to SEQ ID NO: 1 is selected from the group consisting of S214Q, S214H, S214E, S214N, S214F, S214L, S214I, S214M, S214K, and S214D. In some cases, said amino acid sequence is selected from the group consisting of SEQ ID NOs: 160, 161, 162, 164, 165, 166, 167, 168, 169, and 171. In some cases, said at least one amino acid substitution to SEQ ID NO: 1 is selected from the group consisting of Y288F, Y288L, Y288I, Y288M, Y288T, Y288C, Y288A, Y288W, Y288P, Y288S, Y288G, and Y288R. In some cases, said amino acid sequence is selected from the group consisting of SEQ ID NOs: 98, 99, 102, 103, 105, 107, 108, and 109-117.

In some cases, said at least one amino acid substitution to SEQ ID NO: 1 comprises two or more amino acid substitution to SEQ ID NO: 1 selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T, Q161S, V294A, and Q295A; A53T, Q161S, and Q295A; A53T, Q161S, and V294A; A53T, Q161S, V294N, and Q295A; A53T, Q161S, and V294N; Q161S, V294A, and Q295A; A53T and V294A; A53T, Q161S, and Q295W; A53T, V294A, and Q295A; A53T, Q161S, V294N, and Q295W; A53T, Q161S, V294A, and Q295W; Q161S and Q295L; A53T and Q161S; Q161S, V294A, and Q295W; Q161S and Q295F; A53T and Q295W; A53T and Q295A; A53T, V294A, and Q295W; A53T and Q295F; A53T and S177W; S177W and Q295A; Q161S and S177W; S214R and Q295F; A53T and S214R; Q165 and S214R; Q161S and Q295L; A53T and Q161S; Q161S and Q295F; A53T and Q295F; and A53T and V294A. In some cases, said amino acid sequence is selected from the group consisting of SEQ ID NOs: 275-294; and 296-299.

In some cases, said recombinant polypeptide converts O and geranyl diphosphate (GPP) to CBG and 5-GO, and wherein said recombinant polypeptide produces a ratio of an amount of 5-GO to a combined amount of CBG and 5-GO that is higher than wild-type ORF2 enzyme under the same condition. In some cases, said ratio is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295Y, Q295N, Q295D, Q295W, Q295T, Q295V, Q295P, Q295I, Q295R, Q295K, and Q295E. In some cases, said amino acid sequence is selected from the group consisting of SEQ ID NOs: 140, 141, 145, 146, 149, 150, 152, 154, 155, 156, and 157. In some cases, said at least one amino acid substitution to SEQ ID NO: 1 is selected from the group consisting of Q161R, Q161K, and Q161P. In some cases, said amino acid sequence is selected from the group consisting of SEQ ID NOs: 126, 130, and 132. In some cases, said at least one amino acid substitution to SEQ ID NO: 1 is selected from the group consisting of S214W, S214V, S214T, S214R, S214C, S214P, and S214G. In some cases, said amino acid sequence is selected from the group consisting of SEQ ID NOs: 159, 163, 170, 172, 174, 175, and 176. In some cases, said at least one amino acid substitution to SEQ ID NO: 1 is selected from the group consisting of Y288N, Y288H, Y288D, Y288K, and Y288E. In some cases, said amino acid sequence is selected from the group consisting of SEQ ID NOs: 100, 101, 104, 106, and 109. In some cases, said at least one amino acid substitution to SEQ ID NO: 1 is selected from the group consisting of V49A and Q295L; V49A and S214R; and S177W and S214R. In some cases, said amino acid sequence is selected from the group consisting of SEQ ID NOs: 288, 291, and 292.

In some cases, said recombinant polypeptide converts 0 and geranyl diphosphate (GPP) to CBG and 5-GO, and wherein said recombinant polypeptide produces a combined amount of CBG and 5-GO that is higher than wild-type ORF2 enzyme under the same condition. In some cases, said combined amount is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H, Q295M, Q295G, Q295F, Q295W, and Q295D. In some cases, said amino acid sequence is selected from the group consisting of SEQ ID NOs: 140, 142, 143, 144, 148, and 156. In some cases, said at least one amino acid substitution to SEQ ID NO: 1 is selected from the group consisting of Q161F, Q161Y, Q161L, Q161H, Q161I, Q161M, Q161C, Q161T, Q161S, Q161D, Q161G, Q161R, Q161N, and Q161W. In some cases, said amino acid sequence is selected from the group consisting of SEQ ID NOs: 119, 120, 122, 123, 124, 125, 127, 128, 129, 132, 133, 134, 136, and 137. In some cases, said at least one amino acid substitution to SEQ ID NO: 1 is selected from the group consisting of S214Q, S214H, S214E, S214N, S214F, S214I, S214L, and S214M. In some cases, said amino acid sequence is selected from the group consisting of SEQ ID NOs: 161, 162, 164, 165, 167, 168, 169, and 171. In some cases, said at least one amino acid substitution to SEQ ID NO: 1 is selected from the group consisting of Y288F, Y288L, Y288I, Y288M, Y288T, Y288C, and Y288P. In some cases, said amino acid sequence is selected from the group consisting of SEQ ID NOs: 99, 102, 105, 107, 108, 110, and 114.

In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) Q161S and Q295L; A53T and Q161S; Q161S and Q295F; A53T, Q161S, V294A, and Q295A; A53T, Q161S, and Q295A; A53T and Q295F; A53T, Q161S, and V294A; A53T, Q161S, V294N, and Q295A; A53T, Q161S, and V294N; Q161S, V294A, and Q295A; A53T and V294A; A53T, Q161S, and Q295W; A53T, V294A, and Q295A; A53T, Q161S, V294N, and Q295W; A53T, Q161S, V294A, and Q295W; Q161S, V294A, and Q295W; A53T and S177W; A53T and Q295W; A53T and Q295W; A53T and Q295A; A53T, V294A, and Q295W; S177W and Q295A; and Q161S and S177W.

In some cases, said amino acid sequence is selected from the group consisting of SEQ ID NOs: 214, 224, 272, 273, 274, 275, 276, 277, 278, 279, 280, 281, 282, 283, 284, 285, 286, 287, 289, 290, 293, 296, and 297. In some cases, said recombinant polypeptide converts 0 and geranyl diphosphate (GPP) to CBG and 5-GO, and wherein said recombinant polypeptide has a CBG production potential that is higher than wild-type ORF2 enzyme under the same condition. In some cases, said CBGVA production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H, Q295M, Q295G, Q295F, Q295W, and Q295C. In some cases, said amino acid sequence is selected from the group consisting of SEQ ID NOs: 139, 142, 143, 144, 148, and 156. In some cases, said at least one amino acid substitution to SEQ ID NO: 1 is selected from the group consisting of Q161F, Q161Y, Q161L, Q161H, Q161M, Q161I, Q161C, Q161S, Q161T, Q161D, Q161G, and Q161W. In some cases, said amino acid sequence is selected from the group consisting of SEQ ID NOs: 119, 120, 122, 123, 124, 125, 127, 128, 133, 134, 136, and 137. In some cases, said at least one amino acid substitution to SEQ ID NO: 1 is selected from the group consisting of S214Q, S214H, S214E, S214N, S214F, S214I, S214L, and S214M. In some cases, said amino acid sequence is selected from the group consisting of SEQ ID NOs: 161, 162, 164, 165, 167, 168, 169, and 171. In some cases, said at least one amino acid substitution to SEQ ID NO: 1 is selected from the group consisting of Y288F, Y288L, Y288I, Y288M, Y288T, Y288C, and Y288W. In some cases, said amino acid sequence is selected from the group consisting of SEQ ID NOs: 99, 102, 105, 107, 108, 114, and 116.

In some cases, said at least one amino acid substitution to SEQ ID NO: 1 comprises two or more amino acid substitutions selected from the group consisting of:

(a) A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W; or (b) A53T_Q161S_V294A_Q295W, A53T_Q161S_V294A, Q161S_Q295L, A53T_Q295F, A53T_Q295A, A53T_Q161S_V294N, Q161S_Q295F, A53T_Q161S_Q295W, A53T_Q161S, A53T_S177W, Q161S_V294A_Q295W, A53T_V294A, A53T_V294A_Q295W, S177W_Q295A, Q161S_S177W, and A53T_S214R.

In some cases, said amino acid sequence is selected from the group consisting of SEQ ID NOs: 224, 272, 273, 275, 280, 282, 283, 284, 285, 287, 289, 290, 293, 294, 296, and 297. In some cases, said recombinant polypeptide converts 0 and geranyl diphosphate (GPP) to CBG and 5-GO, and wherein said recombinant polypeptide has a 5-GO production potential that is higher than wild-type ORF2 enzyme under the same condition. In some cases, said 5-GO production potential is 10%, 20%, 30%, 40%, 50%, 60%, 70%, 80%, 90%, 100%, 150%, or 200% higher than wild-type ORF2 enzyme under the same condition. In some cases, said at least one amino acid substitution to SEQ ID NO: 1 is selected from the group consisting of Q295H, Q295W, and Q295F. In some cases, said amino acid sequence is selected from the group consisting of SEQ ID NOs: 142, 144, and 156. In some cases, said at least one amino acid substitution to SEQ ID NO: 1 is selected from the group consisting of Q161L, Q161Y, Q161F, Q161I, Q161C, Q161M, Q161T, Q161H, Q161S, Q161R, Q161G, Q161N, and Q161D. In some cases, said amino acid sequence is selected from the group consisting of SEQ ID NOs: 119, 120, 122, 123, 124, 125, 127, 128, 129, 132, 133, 134, and 137. In some cases, said at least one amino acid substitution to SEQ ID NO: 1 is S214E, S214I, S214T, S214F, S214M, S214L, S214G, S214N, S214V, S214C, S214D, and S214Y. In some cases, said amino acid sequence is SEQ ID NO: 159, 160, 161, 162, 163, 165, 167, 168, 169, 174, 175, and 177. In some cases, said at least one amino acid substitution to SEQ ID NO: 1 is Y288F and Y288L. In some cases, said amino acid sequence is SEQ ID NO: 102 and 107.

In another aspect, the disclosure provides recombinant polypeptide comprising an amino acid sequence with at least 95% sequence identity to SEQ ID NO: 1, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a ratio of an amount of CBGA to a combined amount of CBGA and 5-GOA that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a ratio of an amount of 5-GOA to a combined amount of CBGA and 5-GOA that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide produces a combined amount of CBGA and 5-GOA that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide has a CBGA production potential that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide has a 5-GOA production potential that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts DVA and geranyl diphosphate (GPP) to CBGVA and 5-GDVA, and wherein said recombinant polypeptide produces a ratio of an amount of CBGVA to a combined amount of CBGVA and 5-GDVA that is higher than wild-type ORF2 enzyme under the same condition.

In another aspect, the disclosure provides a recombinant polypeptide comprising an amino acid sequence with at least 95% sequence identity to SEQ ID NO: 1, wherein said recombinant polypeptide converts DVA and geranyl diphosphate (GPP) to CBGVA and 5-GDVA, and wherein said recombinant polypeptide produces a ratio of an amount of 5-GDVA to a combined amount of CBGVA and 5-GDVA that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts DVA and geranyl diphosphate (GPP) to CBGVA and 5-GDVA, and wherein said recombinant polypeptide produces a combined amount of CBGVA and 5-GDVA that is higher than wild-type ORF2 enzyme under the same condition.

In another aspect, the disclosure provides a recombinant polypeptide comprising an amino acid sequence with at least 95% sequence identity to SEQ ID NO: 1, wherein said recombinant polypeptide converts DVA and geranyl diphosphate (GPP) to CBGVA and 5-GDVA, and wherein said recombinant polypeptide has a CBGVA production potential that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts DVA and geranyl diphosphate (GPP) to CBGVA and 5-GDVA, and wherein said recombinant polypeptide has a 5-GDVA production potential that is higher than wild-type ORF2 enzyme under the same condition.

In another aspect, the disclosure provides a recombinant polypeptide comprising an amino acid sequence with at least 95% sequence identity to SEQ ID NO: 1, wherein said recombinant polypeptide converts Olivetol (O) and geranyl diphosphate (GPP) to CBG and 5-GO, and wherein said recombinant polypeptide produces a ratio of an amount of CBG to a combined amount of CBG and 5-GO that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts Olivetol (O) and geranyl diphosphate (GPP) to CBG and 5-GO, and wherein said recombinant polypeptide produces a ratio of an amount of 5-GO to a combined amount of CBG and 5-GO that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts Olivetol (O) and geranyl diphosphate (GPP) to CBG and 5-GO, and wherein said recombinant polypeptide produces a combined amount of CBG and 5-GO that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts Olivetol (O) and geranyl diphosphate (GPP) to CBG and 5-GO, and wherein said recombinant polypeptide has a CBG production potential that is higher than wild-type ORF2 enzyme under the same condition.

In one aspect, the disclosure provides a recombinant polypeptide comprising an amino acid sequence with at least 95% sequence identity to SEQ ID NO: 1, wherein said recombinant polypeptide converts Olivetol (O) and geranyl diphosphate (GPP) to CBG and 5-GO, and wherein said recombinant polypeptide has a 5-GO production potential that is higher than wild-type ORF2 enzyme under the same condition.

In some cases, said amino acid sequence has at least 96%, 97%, 98%, or 99% sequence identity to SEQ ID NO: 1. In some cases, said at least one amino acid substitution comprises 1, 2, 3, 4, 5, 6, 7, 8, 9, 10, 11, 12, 13, 14, or 15 amino acid substitutions to SEQ ID NO: 1. In some cases, said at least one amino acid substitution is located on a position chosen from the group consisting of 1-46, 48-63, 65-109, 111-120, 122, 124, 125, 127-160, 162-174, 176, 178-213, 215, 217-287, 289-293, and 296-307. In some cases, said amino acid sequence comprises said at least one amino acid substitution to SEQ ID NO: 1 at a position selected from the group consisting of A17, C25, Q38, V49, A53, M106, A108, E112, K118, K119, Y121, F123, Q161, M162, D166, N173, L174, 5177, G205, C209, F213, 5214, Y216, L219, D227, R228, C230, A232, V271, L274, Y283, G286, Y288, V294, Q295, and L298. In some cases, said at least one amino acid substitution to SEQ ID NO: 1 is selected from the group consisting of A17T, C25V, Q38G, V49A, V49L, V49S, A53C, A53D, A53E, A53F, A53G, A53H, A53I, A53K, A53L, A53M, A53N, A53P, A53Q, A53R, A53S, A53T, A53V, A53W, A53Y, M106E, A108G, E112D, E112G, K118N, K118Q, K119A, K119D, Y121W, F123A, F123H, F123W, Q161A, Q161C, Q161D, Q161E, Q161F, Q161G, Q161H, Q161I, Q161K, Q161L, Q161M, Q161N, Q161P, Q161R, Q161S, Q161T, Q161V, Q161W, Q161Y, M162A, M162F, D166E, N173D, L174V, S177E, S177W, S177Y, G205L, G205M, C209G, F213M, S214A, S214C, S214D, S214E, S214F, S214G, S214H, S214I, S214K, S214L, S214M, S214N, S214P, S214Q, S214R, S214T, S214V, S214W, S214Y, Y216A, L219F, D227E, R228E, R228Q, C230N, C230S, A232S, V271E, L274V, Y283L, G286E, Y288A, Y288C, Y288D, Y288E, Y288F, Y288G, Y288H, Y288I, Y288K, Y288L, Y288M, Y288N, Y288P, Y288Q, Y288R, Y288S, Y288T, Y288V, Y288W, V294A, V294F, V294N, Q295A, Q295C, Q295D, Q295E, Q295F, Q295G, Q295H, Q295I, Q295K, Q295L, Q295M, Q295N, Q295P, Q295R, Q295S, Q295T, Q295V, Q295W, Q295Y, L298A, L298Q, and L298W. In some cases, the recombinant polypeptide comprises any one of the recombinant polypeptides disclosed herein.

In some aspects, the disclosure provides a nucleic acid molecule, comprising a nucleotide sequence encoding any one of the recombinant polypeptides disclosed herein, or a codon degenerate nucleotide sequence thereof.

In one aspect, the disclosure provides a nucleic acid molecule, comprising a nucleotide sequence with at least 95% sequence identity to a sequence selected from the group consisting of SEQ ID NO: 1-198 or a codon degenerate nucleotide sequence thereof. In some cases, the nucleotide sequence comprises at least 500, 600, 700, 800, or 900 nucleotides. In some cases, said nucleic acid molecule is isolated and purified.

In one aspect, the disclosure provides a cell vector, construct or expression system comprising any or more of the nucleic acid molecules disclosed herein.

In one aspect, the disclosure provides a cell, comprising said cell vector, construct or expression system disclosed herein. In some cases, said cell is a bacteria, yeast, insect, mammalian, fungi, vascular plant, or non-vascular plant cell. In some cases, said cell is a microalgae cell. In some cases, said cell is an E. coli cell.

In one aspect, the disclosure provides a plant comprising any cell disclosed herein. In some cases, the plant is a terrestrial plant.

In one aspect, the disclosure provides a method of producing a prenylation product, comprising: contacting the recombinant polypeptide with a substrate and a donor, thereby producing said prenylation product. In some cases, said substrate comprises olivetolic acid (OA), divarinolic acid (DVA), olivetol (O), resveratrol, piceattanol and related stilbenes, naringenin, apigenin and related flavanones and flavones, respectively, Isoliquiritigenin, 2'-O-methyl-isoliquiritigenin and related chalcones, catechins and epicatechins of all possible stereoisomers, biphenyl compounds such as 3,5-dihydroxy-biphenyl, benzophenones such as phlorobenzophenone, isoflavones such as biochanin A, genistein, daidzein, 2,4-dihydroxybenzoic acid, 1,3-benzenediol, 2,4-dihydroxy-6-methylbenzoic acid; 1,3-Dihydroxy-5-methylbenzene; 2,4-Dihydroxy-6-aethyl-benzoesaeure; 5-ethylbenzene-1,3-diol 2,4-dihydroxy-6-propylbenzoic acid; 5-propylbenzene-1,3-diol; 2-butyl-4,6-dihydroxybenzoic acid; 5-butylbenzene-1,3-diol; 2,4-dihydroxy-6-pentyl-benzoic acid; 5-pentylbenzene-1,3-diol; 5-hexylbenzene-1,3-diol; 2-heptyl-4,6-dihydroxy-benzoic acid; 5-heptylbenzene-1,3-diol; 5-Dodecylbenzene-1,3-diol; 5-nonadecylbenzene-1,3-diol; 1,3-Benzenediol; 3,4',5-Trihydroxystilbene; 4'5-Tetrahydroxystilbene; 1,2-Diphenyl-ethylene; 2-Phenylbenzopyran-4-one; 2-Phenylchroman-4-one; 1,3-benzenediol; 5,7,4'-Trihydroxyflavone; (E)-1-(2,4-dihydroxyphenyl)-3-(4-hydroxyphenyl)prop-2-en-1-one; 4,4'-dihydroxy-2'-methoxychalcone; 1,3-Diphenylpropenone; (2R,3 S)-2-(3,4-Dihydroxyphenyl)chroman-3,5,7-triol; (2R,3R)-2-(3,4-Dihydroxyphenyl)-3,5,7-chromanetriol; Phenylbenzene; 5-Phenylresorcinol; diphenylmethanone; 3-phenyl-4H-chromen-4-one; 5,7-Dihydroxy-3-(4-methoxyphenyl)-4H-chromen-4-one; 4',5,7-Trihydroxyisoflavone; 4',7-Dihydroxyisoflavone; 4-Hydroxy-6-methyl-2H-pyran-2-one; 1,6-DHN; or any combination thereof. In some cases, said substrate comprises olivetolic acid (OA), olivetol (O), or divarinic acid (DVA). In some cases, said donor comprises dimethylallyl pyrophosphate (DMAPP), geranyl pyrophosphate (GPP), or farnesyl pyrophosphate (FPP). In some cases, said substrate comprises olivetolic acid (OA) and said donor comprises geranyl pyrophosphate (GPP), and wherein said prenylation product comprises CBGA, 5-GOA, or a prenylated product on any other position on an aromatic ring of said substrate.

In some cases, said prenylation product comprises CBGA and 5-GOA, and wherein said recombinant polypeptide produces a ratio of an amount of CBGA to a combined amount of CBGA and 5-GOA that is higher than wild-type ORF2 enzyme under the same acid condition. In some cases, said prenylation product comprises CBGA and 5-GOA, and wherein said recombinant polypeptide produces a ratio of an amount of 5-GOA to a combined amount of CBGA and 5-GOA that is higher than wild-type ORF2 enzyme under the same acid condition. In some cases, said prenylation product comprises CBGA and 5-GOA, and wherein said recombinant polypeptide produces a combined amount of CBGA and 5-GOA that is higher than wild-type ORF2 enzyme under the same acid condition. In some cases, said prenylation product comprises CBGA and 5-GOA, and wherein said recombinant polypeptide has a CBGA production potential that is higher than wild-type ORF2 enzyme under the same acid condition.

In some cases, said acid condition has a pH of less than 7. In some cases, said acid condition has a pH of less than 6. In some cases, said acid condition has a pH of about 5.3. In some cases, said substrate comprises olivetol (O) and said donor comprises geranyl pyrophosphate (GPP), and wherein said prenylation product comprises CBG, 5-GO or a prenylated product on any other position on an aromatic ring of said substrate. In some cases, said substrate comprises divarinic acid (DVA) and said donor comprises geranyl pyrophosphate (GPP), and wherein said prenylation product comprises CBGVA, 5-GDVA or a prenylated product on any other position on an aromatic ring of said substrate.

In some cases, said contacting comprises contacting said substrate and said donor with said recombinant polypeptide in a cell. In some cases, said cell is a bacteria, yeast, insect, mammalian, fungi, microalgae, or plant cell. In some cases, said contacting comprises contacting said substrate and said donor with said recombinant polypeptide in a cell-free reaction. In some cases, said contacting comprises contacting said substrate and said donor with said recombinant polypeptide in a reaction, wherein said recombinant polypeptide is secreted by a cell into a media before the contacting.

In yet another aspect, the disclosure provides a composition, comprising a prenylation product and any one recombinant polypeptide disclosed herein. In some cases, said prenylation product comprises CBGA, CBG, CBGVA or any combination thereof. In some cases, said prenylation product comprises 5-GOA, 5-GO. In some cases, said prenylation product comprises 5-GDVA.

In one aspect, the disclosure provides a method of screening for an ORF2 mutant, comprising: providing two or more ORF2 mutants; contacting each of said two or more ORF2 mutants with a substrate and a donor, thereby producing at least two prenylation products under the same condition; measuring a ratio of an amount of one of said at least two prenylation products to a combined amount of said at least two prenylation products for each of said two or more ORF2 mutants; and identifying said ORF2 mutant with the highest ratio among said two or more ORF2 mutants. In some cases, each of said two or more ORF2 mutants comprises an amino acid sequence with at least 95%, 96%, 97%, 98%, or 99% identity to SEQ ID NO: 1. In some cases, said two or more ORF2 mutants comprises different amino acid sequences. In some cases, each of said amino acid sequences comprises at least one amino acid substitution to SEQ ID NO: 1. In some cases, each of said at least one amino acid substitution is located at a different amino acid position. In some cases, said at least one amino acid substitution is located on a position chosen from the group consisting of amino acid positions 1-46, 48-63, 65-109, 111-120, 122, 124, 125, 127-160, 162-174, 176, 178-213, 215, 217-287, 289-293, and 296-307. In some cases, said at least one amino acid substitution is located on a position chosen from the group consisting of amino acid positions 17, 25, 38, 49, 53, 106, 108, 112, 118, 119, 121, 123, 161, 162, 166, 173, 174, 177, 205, 209, 213, 214, 216, 219, 227, 228, 230, 232, 271, 274, 283, 286, 288, 294, 295, and 298.

In some cases, said substrate comprises olivetolic acid (OA), divarinolic acid (DVA), olivetol (O), resveratrol, piceattanol and related stilbenes, naringenin, apigenin and related flavanones and flavones, respectively, Isoliquiritigenin, 2'-O-methylisoliquiritigenin and related chalcones, catechins and epi-catechins of all possible stereoisomers, biphenyl compounds such as 3,5-dihydroxy-biphenyl, benzophenones such as phlorobenzophenone, isoflavones such as biochanin A, genistein, daidzein, 2,4-dihydroxybenzoic acid, 1,3-benzenediol, 2,4-dihydroxy-6-methylbenzoic acid; 1,3-Dihydroxy-5-methylbenzene; 2,4-Dihydroxy-6-aethyl-benzoesaeure; 5-ethylbenzene-1,3-diol 2,4-dihydroxy-6-propylbenzoic acid; 5-propylbenzene-1,3-diol; 2-butyl-4,6-dihydroxybenzoic acid; 5-butylbenzene-1,3-diol; 2,4-dihydroxy-6-pentyl-benzoic acid; 5-pentylbenzene-1,3-diol; 5-hexylbenzene-1,3-diol; 2-heptyl-4,6-dihydroxy-benzoic acid; 5-heptylbenzene-1,3-diol; 5-Dodecylbenzene-1,3-diol; 5-nonadecylbenzene-1,3-diol; 1,3-Benzenediol; 3,4',5-Trihydroxystilbene; 4'5-Tetrahydroxystilbene; 1,2-Diphenyl-ethylene; 2-Phenylbenzopyran-4-one; 2-Phenylchroman-4-one; 1,3-benzenediol; 5,7,4'-Trihydroxyflavone; (E)-1-(2,4-dihydroxyphenyl)-3-(4-hydroxyphenyl)prop-2-en-1-one; 4,4'-dihydroxy-2'-methoxychalcone; 1,3-Diphenylprope-none; (2R,3 S)-2-(3,4-Dihydroxyphenyl)chroman-3,5,7-triol; (2R,3R)-2-(3,4-Dihydroxyphenyl)-3,5,7-chromanetriol; Phenylbenzene; 5-Phenylresorcinol; diphenylmethanone; 3-phenyl-4H-chromen-4-one; 5,7-Dihydroxy-3-(4-methoxyphenyl)-4H-chromen-4-one; 4',5,7-Trihydroxyisoflavone; 4',7-Dihydroxyisoflavone; 4-Hydroxy-6-methyl-2H-pyran-2-one; 1,6-DHN; or any combination thereof.

In some cases, said substrate comprises olivetolic acid (OA), olivetol (O), or divarinic acid (DVA). In some cases, said donor comprises dimethylallyl pyrophosphate (DMAPP), geranyl pyrophosphate (GPP), or farnesyl pyrophosphate (FPP). In some cases, said substrate comprises olivetolic acid (OA) and said donor comprises geranyl pyrophosphate (GPP), and wherein said at least two prenylation products comprises CBGA and 5-GOA. In some cases, said substrate comprises olivetol (O) and said donor comprises geranyl pyrophosphate (GPP), and wherein said at least two prenylation products comprises CBG and 5-GO. In some cases, said substrate comprises divarinic acid (DVA) and said donor comprises geranyl pyrophosphate (GPP), and said at least two prenylation products comprises CBGVA and 5-GDVA.

In one aspect, the disclosure provides methods of making a prenyltransferase mutant, comprising: aligning a crystal structure of a prenyltransferase with a crystal structure of wild-type ORF2 enzyme; identifying an amino acid position on said prenyltransferase corresponding to any one of amino acid positions 17, 25, 38, 49, 53, 106, 108, 112, 118, 119, 162, 166, 173, 174, 205, 209, 213, 219, 227, 228, 230, 232, 271, 274, 283, 286, 288, and 298 on said wild-type ORF2 enzyme, based on alignment of said crystal structures; and substitute said amino acid position on said prenyltransferase with a different amino acid, thereby generating said prenyltransferase mutant.

In one aspect, the disclosure provides a method of making a prenyltransferase mutant, comprising: aligning an amino acid sequence of a prenyltransferase with an amino acid sequence of wild-type ORF2 enzyme; identifying an amino acid position on said prenyltransferase corresponding to any one of amino acid positions 17, 25, 38, 49, 53, 106, 108, 112, 118, 119, 162, 166, 173, 174, 205, 209, 213, 219, 227, 228, 230, 232, 271, 274, 283, 286, 288, and 298 on said wild-type ORF2 enzyme, based on alignment of said amino acid sequences; and substitute said amino acid position on said prenyltransferase with a different amino acid, thereby generating said prenyltransferase mutant.

In some cases, said at least one amino acid substitution to SEQ ID NO: 1 is selected from the group consisting of A53T, A53I, A53V, A53L, A53M, A53K, A53S, A53C, and A53Q. In some cases, said amino acid sequence is selected from the group consisting of SEQ ID NOs: 179, 185, 186, 187, 188, 191, 193, 194, and 195. In some cases, said at least one amino acid substitution to SEQ ID NO: 1 is selected from the group consisting of A53L, A53K, A53V, A53M, A53Q, A53T, A53S, A53C, and A53I. In some cases, said amino acid sequence is selected from the group consisting of SEQ ID NOs: 179, 185, 186, 187, 188, 191, 193, 194, and 195. In some cases, said at least one amino acid substitution to SEQ ID NO: 1 is selected from the group consisting of A53L, A53T, A53V, A53I, A53M, A53Q, A53K, and A53S.

In some cases, said amino acid sequence is selected from the group consisting of SEQ ID NOs: 185, 186, 187, 188, 191, 193, 194, and 195.

BRIEF DESCRIPTION OF THE FIGURES

FIG. 36 shows the total amount of prenylated products (FIG. 36A) and % CBGVA in prenylated products (FIG. 36B) of A04 ORF2 mutant using DVA as substrate and GPP as donor.

FIG. 46 shows that CBGVA production potential of the new ORF2 mutants generated by stacking the selected mutations.

FIG. 103: Analysis of ORF-2 enzymatic function of single mutants derived from the breakdown of ORF-2 triple mutant clone G12—including total prenylated products (FIG. 103A); and % CBGVA produced (FIG. 103B).

DETAILED DESCRIPTION

Definitions

Figure 1:
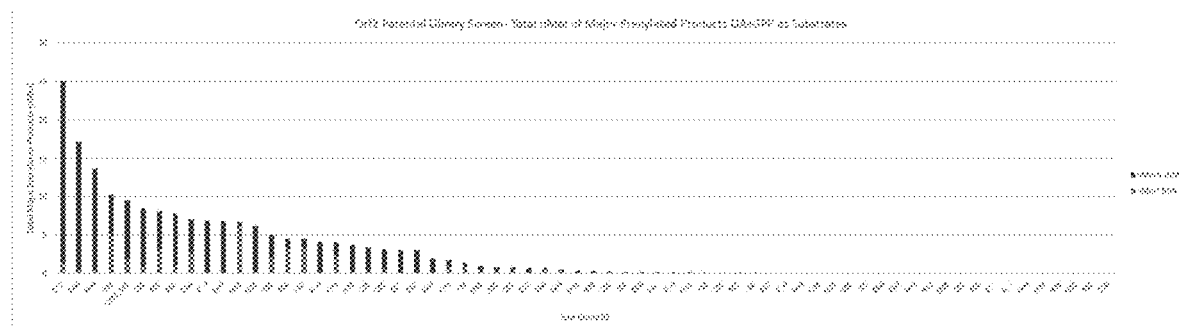
FIG. 1 shows the total nMol of prenylated products produced by ORF2 triple mutants using OA as substrate and GPP as donor.

As used herein, and in the appended claims, the singular forms "a", "an", and "the" include plural referents unless the context clearly dictates otherwise. Thus, for example, reference to "a protein" can refer to one protein or to mixtures of such protein, and reference to "the method" includes reference to equivalent steps and/or processes known to those skilled in the art, and so forth.

As used herein, the term "about" or "approximately" when preceding a numerical value indicates the value plus or minus a range of 10%. For example, "about 100" encompasses 90 and 110.

The term "wild type", abbreviated as "WT", is a term of the art understood by skilled persons and means the typical form of an organism, strain, gene, protein, or characteristic as it occurs in nature as distinguished from mutant or variant forms. For example, a WT protein is the typical form of that protein as it occurs in nature.

The term "mutant protein" is a term of the art understood by skilled persons and refers to a protein that is distinguished from the WT form of the protein on the basis of the presence of amino acid modifications, such as, for example, amino acid substitutions, insertions and/or deletions.

Amino acid modifications may be amino acid substitutions, amino acid deletions and/or amino acid insertions. Amino acid substitutions may be conservative amino acid substitutions or non-conservative amino acid substitutions. A conservative replacement (also called a conservative mutation, a conservative substitution or a conservative variation) is an amino acid replacement in a protein that changes a given amino acid to a different amino acid with similar biochemical properties (e.g. charge, hydrophobicity and size). As used herein, "conservative variations" refer to the replacement of an amino acid residue by another, biologically similar residue. Examples of conservative variations include the substitution of one hydrophobic residue such as isoleucine, valine, leucine or methionine for another; or the substitution of one polar residue for another, such as the substitution of arginine for lysine, glutamic for aspartic acids, or glutamine for asparagine, and the like. Other illustrative examples of conservative substitutions include the changes of: alanine to serine; arginine to lysine; asparagine to glutamine or histidine; aspartate to glutamate; cysteine to serine; glutamine to asparagine; glutamate to aspartate; glycine to praline; histidine to asparagine or glutamine; isoleucine to leucine or valine; leucine to valine or isoleucine; lysine to arginine, glutamine, or glutamate; methionine to leucine or isoleucine; phenylalanine to tyrosine, leucine or methionine; serine to threonine; threonine to serine; tryptophan to tyrosine; tyrosine to tryptophan or phenylalanine; valine to isoleucine or leucine, and the like.

Amino acid substitution, interchangeably referred to as amino acid replacement, at a specific position on the protein sequence is denoted herein in the following manner: "one letter code of the WT amino acid residue—amino acid position—one letter code of the amino acid residue that replaces this WT residue". For example, an ORF2 polypeptide which is a Q295F mutant refers to an ORF2 polypeptide in which the wild type residue at the $295^{th}$ amino acid position (Q or glutamine) is replaced with F or phenylalanine. Some mutants have more than one amino acid substitutions, for example, mutant L174V_S177E refers to an ORF2 polypeptide in which the wild type residue at the 174th amino acid position (L or leucine) is replaced with V or valine; and the wild type residue at the 177th amino acid position (S or serine) is replaced with E or glutamic acid.

The modified peptides can be chemically synthesized, or the isolated gene can be site-directed mutagenized, or a synthetic gene can be synthesized and expressed in bacteria, yeast, baculovirus, tissue culture, and the like.

As used herein, "total prenylated products" produced refers to the sum of nMols of the various prenylated products produced by an enzyme in a set period of time. For instance, when OA is used as a substrate and GPP is used as a donor, then the "total prenylated products" refers to a sum of the nMol of CBGA and the nMol of 5-GOA produced by the prenyltranferase enzyme ORF2 in a set period of time.

As used herein, "% prenylated product 1" within total prenylated products is calculated using the equation: nMol of prenylated product 1/[nMol of total prenylated products]. For example, "% CBGA" is calculated using the equation: nMol of CBGA/[nMol of CBGA+5-GOA]. Also, as an example, "%5-GOA" within prenylated products is calculated using the equation: nMol of 5-GOA/[nMol of CBGA+5-GOA].

As used herein, % enzymatic activity of an ORF2 mutant is calculated using the equation: total prenylated products produced by a mutant/total prenylated products produced by wild-type ORF2. For example, wild-type ORF2 has 100% enzyme activity.

As used herein, the production or production potential of a prenylated product 1 is calculated using the formula: % product 1 among total prenylated products*% enzymatic activity. For example, "CBGA production potential" (used interchangeably with "CBGA production") is calculated using the equation: % CBGA among total prenylated products*% enzymatic activity. Also, as an example, "5-GOA production potential" (used interchangeably with "5-GOA production") is calculated using the equation: %5-GOA among total prenylated products*enzymatic activity.

A "vector" is used to transfer genetic material into a target cell. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, adenoviruses, lentiviruses, and adeno-associated viruses). In embodiments, a viral vector may be replication incompetent. Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

As used herein "sequence identity" refers to the extent to which two optimally aligned polynucleotides or polypeptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as, for example, those in the BLAST suite of sequence analysis programs.

Cannabinoid Synthesis

The biosynthesis of cannabinoids often starts with the short-chain fatty acid, hexanoic acid. Initially, the fatty acid is converted to its coenzyme A (CoA) form by the activity of an acyl activating enzyme. Subsequently, olivetolic acid (OA) is biosynthesized by the action of a type III polyketide synthase (PKS), and, in some cases, a polyketide cyclase (olivetolic acid cyclase [OAC]).

A geranyl diphosphate:olivetolate geranyltransferase, named cannabigerolic acid synthase (CBGAS), is responsible for the C-alkylation by geranyl diphosphate (GPP) to CBGA. Subsequently, the monoterpene moiety of CBGA is often stereoselectively cyclized by three different enzymes cannabichromenic acid synthase (CBCAS), cannabidiolic acid synthase (CBDAS) and tetrahydrocannabinolic acid synthase (THCAS) to synthesize cannabichromenic acid (CBCA), cannabidiolic acid (CBDA) and $\Delta^9$-THCA, respectively.

The central precursor for cannabinoid biosynthesis, CBGA, is synthesized by the aromatic prenyltransferase CBGAS by the condensation of GPP and OA. In considering the biosynthesis of cannabinoids in a heterologous system, one major challenge is that CBGAS (e.g. CsPT1 and CsPT4) is an integral membrane protein, making high titer of functional expressed protein in *E. coli* and other heterologous systems unlikely. Besides the integral membrane prenyltransferases found in plants, soluble prenyltransferases are found in fungi and bacteria. For instance, *Streptomyces* sp. strain CL190 produces a soluble prenyltransferase NphB or ORF2, which is specific for GPP as a prenyl donor and exhibits broad substrate specificity towards aromatic substrates. When expressed in *E. coli*, ORF2 of SEQ ID NO:2 is as a 33 kDa soluble, monomeric protein having 307 residues. Further details about ORF2 and other aromatic prenyltransferases may be found in U.S. Pat. Nos. 7,361,483; 7,544,498; and 8,124,390, each of which is incorporated herein by reference in its entirety for all purposes.

ORF2 is a potential alternative to replace the native CBGAS in a biotechnological production of cannabinoids and other prenylated aromatic compounds. However, the wild type ORF2 enzyme produces a large amount of 5-geranyl olivetolate (5-GOA) and only a minor amount of CBGA, the latter of which is the desired product for cannabinoid biosynthesis.

This disclosure provides ORF2 mutants, engineered by the inventors to produce higher ratios of CBGA to 5-GOA (and other compounds), as compared to WT ORF2; as well as ORF2 mutants which have been engineered to catalyze reactions using a desired substrate and to produce higher amounts of a desired product.

ORF2 mutants

The disclosure provides recombinant polypeptides comprising an amino acid sequence with at least about 70% identity to the amino acid sequence of WT ORF2 (set forth in SEQ ID NO: 1). In some aspects, the polypeptides disclosed herein may have a sequence identity of about 70%, about 75%, about 80%, about 85%, about 90%, about 95%, about 96%, about 97%, about 98%, about 99%, or about 99.5% identity to the amino acid sequence of WT ORF2 (set forth in SEQ ID NO: 1). In some aspects, the mutant ORF2 polypeptides disclosed herein may comprise a modification at one or more amino acids, as compared to the WT ORF2 sequence. In some aspects, the mutant ORF2 polypeptides disclosed herein may comprise a modification at 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids, as compared to the WT ORF2 sequence.

In some aspects, mutant ORF2 polypeptides disclosed herein comprise a modification in one or more amino acid residues selected from the group consisting of the following amino acid residues, A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298 of the WT ORF2 polypeptide. For instance, the mutant ORF2 polypeptides disclosed herein may comprise an amino acid modification at 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids selected from the group consisting of the following amino acid residues, A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298 of the WT ORF2 polypeptide.

In some aspects, the mutant ORF2 polypeptides disclosed herein may comprise an amino acid substitution of at least one amino acid residue selected from the group consisting of A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298. For instance, the mutant ORF2 polypeptides disclosed herein may comprise an amino acid substitution of 1 amino acid, 2 amino acids, 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, or 36 amino acids selected from the group consisting of A17, C25, Q38, V49, A53, M106, A108, E112, K118, K119, Y121, F123, Q161, M162, D166, N173, L174, S177, G205, C209, F213, S214, Y216, L219, D227, R228, C230, A232, V271, L274, Y283, G286, Y288, V294, Q295, and L298.

In some aspects, the mutant ORF2 polypeptides disclosed herein comprise an amino acid sequence comprising at least one amino acid substitution, as compared to the amino acid sequence of WT ORF2, wherein the at least one amino acid substitution does not comprise an alanine substitution on an amino acid residue selected from the group consisting of 47, 64, 110, 121, 123, 126, 161, 175, 177, 214, 216, 288, 294 and 295.

In some aspects, the mutant ORF2 polypeptides disclosed herein comprise an amino acid sequence comprising at least one amino acid substitution, as compared to the amino acid sequence of WT ORF2, wherein at least one amino acid substitution is at a position selected from the group consisting of 1-46, 48-63, 65-109, 111-120, 122, 124, 125, 127-160, 162-174, 176, 178-213, 215, 217-287, 289-293, 296-307, on WT-ORF2.

In some aspects, the mutant ORF2 polypeptides disclosed herein comprise an amino acid sequence with at least about 70% identity (for instance, about 75%, about 80%, about 85%, about 90%, about 95%, about 96%, about 97%, about 98%, about 99%, or about 99.5% identity, inclusive of all values and subranges therebetween) to the amino acid sequence of SEQ ID Nos 2-300. In some aspects, the mutant ORF2 polypeptides disclosed herein comprise the amino acid sequence of SEQ ID Nos 2-300. In some aspects, the mutant ORF2 polypeptides disclosed herein consist of the amino acid sequence of SEQ ID Nos 2-300.

In some aspects, the mutant ORF2 polypeptides disclosed herein catalyze a reaction using GPP as a donor of the prenyl group. In some aspects, the mutant ORF2 polypeptides disclosed herein catalyze a reaction using any known substrate of ORF2, or a homologue thereof. In some aspects, the substrate is selected from the group consisting of olivetolic acid (OA), divarinolic acid (DVA) and olivetol (O). In some aspects, the substrate is any natural or synthetic phenolic acids with a 1,3-dihydroxyl motif, alternatively a resorcinol ring including but not limited to resveratrol, piceattanol and related stilbenes, naringenin, apigenin and related flavanones and flavones, respectively, Isoliquiritigenin, 2'-O-methylisoliquiritigenin and related chalcones, catechins and epi-catechins of all possible stereoisomers, biphenyl compounds such as 3,5-dihydroxy-biphenyl, benzophenones such as phlorobenzophenone, isoflavones such as biochanin A, genistein, and daidzein. For instance, the substrate may be any substrate listed in Tables A and B; and FIGS. 117-119

TABLE A

Examples of ORF2 substrates which are benzoic acids and benzenediols

| IUPAC Chemical Name | Common Name | Tail Chain Length | CAS# |
|---|---|---|---|
| 2,4-dihydroxybenzoic acid | β-Resorcylic acid | 0-carbon | 89-86-1 |
| 1,3-benzenediol | resorcinol | 0-carbon | 108-46-3 |
| 2,4-dihydroxy-6-methylbenzoic acid | o-orsellinic Acid | 1-carbon | 480-64-8 |
| 1,3-Dihydroxy-5-methylbenzene | Orcinol | 1-carbon | 504-15-4 |
| 2,4-Dihydroxy-6-aethyl-benzoesaeure | | 2-carbon | 4299-73-4 |
| 5-ethylbenzene-1,3-diol | | 2-carbon | 4299-72-3 |
| 2,4-dihydroxy-6-propylbenzoic acid | Divarinic Acid | 3-carbon | 4707-50-0 |
| 5-propylbenzene-1,3-diol | Divarin | 3-carbon | 500-49-2 |
| 2-butyl-4,6-dihydroxybenzoic acid | | 4-carbon | 173324-41-9 |
| 5-butylbenzene-1,3-diol | | 4-carbon | 46113-76-2 |
| 2,4-dihydroxy-6-pentyl-benzoic acid; | Olivetolic Acid | 5-carbon | 491-72-5 |
| 5-pentylbenzene-1,3-diol | Olivetol | 5-carbon | 500-66-3 |
| 5-hexylbenzene-1,3-diol | | 6-carbon | 5465-20-3 |
| 2-heptyl-4,6-dihydroxy-benzoic acid | sphaerophorol-carboxylic acid | 7-carbon | 6121-76-2 |
| 5-heptylbenzene-1,3-diol | Sphaerophorol | 7-carbon | 500-67-4 |
| 5-Dodecylbenzene-1,3-diol | | 12-carbon | 72707-60-9 |
| 5-nonadecylbenzene-1,3-diol | | 19-carbon | 35176-46-6 |

TABLE B

Examples of other aromatic compounds which are ORF2 substrates

| IUPAC Chemical Name | Common Name | CAS# |
|---|---|---|
| 1,3-Benzenediol | resorcinol | 108-46-3 |
| 3,4',5-Trihydroxystilbene | resveratrol | 89-86-1 |
| 4'5-Tetrahydroxystilbene | Piceatannol | 4339-71-3 |
| 1,2-Diphenylethylene | stilbene | 103-30-0 |
| 2-Phenylbenzopyran-4-one | flavone | 525-82-6 |
| 2-Phenylchroman-4-one | flavanone | 487-26-3 |
| 1,3-benzenediol | naringenin | 108-46-3 |
| 5,7,4'-Trihydroxyflavone | apigenin | 8002-66-2 |
| (E)-1-(2,4-dihydroxyphenyl)-3-(4-hydroxyphenyl)prop-2-en-1-one | Isoliquiritigenin | 961-29-5 |
| 4,4'-dihydroxy-2'-methoxychalcone | 2'-O-Methyliso-liquiritigenin | 112408-67-0 |
| 1,3-Diphenylpropenone | chalcone | 94-41-7 |
| (2R, 3S)-2-(3,4-Dihydroxyphenyl)chroman-3,5,7-triol | catechin | 7295-85-4 |
| (2R, 3R)-2-(3,4-Dihydroxyphenyl)-3,5,7-chromanetriol | epi-catechin | 7295-85-4 |
| Phenylbenzene | biphenyl | 92-52-4 |
| 5-Phenylresorcinol | 3,5-Dihydroxybiphenyl | 7028-41-3 |
| diphenylmethanone | benzophenone | 119-61-9 |
| 3-phenyl-4H-chromen-4-one | isoflavone | 574-12-9 |
| 5,7-Dihydroxy-3-(4-methoxyphenyl)-4H-chromen-4-one | biochanin A | 491-80-5 |
| 4',5,7-Trihydroxyisoflavone | Genistein | 690224-00-1 |
| 4',7-Dihydroxyisoflavone | Diadzein | 486-66-8 |
| 4-Hydroxy-6-methyl-2H-pyran-2-one | Triacetic acid lactone | 675-10-5 |
| 1,6-DHN | | 575-44-0 |

In some aspects, the products of ORF2 prenylation may further serve as substrates for ORF2. Therefore, the substrate may also be any product of an ORF2 prenylation reaction.

In some aspects, the mutant ORF2 polypeptides disclosed herein produce a higher amount of total nMol of prenylated products than WT ORF2. In some aspects, the mutant ORF2 polypeptides disclosed herein produce an amount of total nMol of prenylated products that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the amount of total nMol of prenylated products produced by WT ORF2.

In some aspects, the mutant ORF2 polypeptides disclosed herein have an enzymatic activity higher than WT ORF2. In some aspects, the mutant ORF2 polypeptides disclosed herein have an activity that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the enzymatic activity of WT ORF2.

ORF2 Mutants Catalyzing a Reaction Using OA as Substrate

In some aspects the mutant ORF2 polypeptides disclosed herein catalyze the reaction converting OA and GPP to CBGA and 5-GOA.

In some aspects, the mutant ORF2 polypeptides disclosed herein produce a higher amount of total nMol of prenylated products than WT ORF2, wherein the mutant ORF2 polypeptides use OA as substrate and GPP as donor; and the prenylated products are CBGA and 5-GOA. In some aspects, the mutant ORF2 polypeptides disclosed herein produce an amount of total nMol of prenylated products that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the amount of total nMol of prenylated products produced by WT ORF2, wherein the prenylated products are CBGA and 5-GOA.

The ratio of CBGA to 5-GOA produced by WT ORF2 is about 20:80. In some aspects, the mutant ORF2 polypeptides disclosed herein produce a ratio of CBGA to 5-GOA that is higher than the ratio of CBGA to 5-GOA produced by WT ORF2 under the same conditions. In some aspects, the mutant ORF2 polypeptides disclosed herein produce a ratio of CBGA to 5-GOA that is lower than the ratio of CBGA to 5-GOA produced by WT ORF2 under the same conditions. In some embodiments, the ratio of CBGA to 5-GOA produced by the mutant ORF2 proteins of this disclosure may range from about 1:99 to up to 20:80; or more than about 20:80 to 99:1, for example about 5:95, about 10:90, about 15:85, about 25:75, about 30:70, about 35:65, about 40:60, about 45:55, about 50:50, about 55:45, about 60:40, about 65:35, about 70:30, about 75:25, about 80:20, about 85:15, about 90:10, about 95:5, or about 99:1, including all values and subranges that lie therebetween.

In some aspects, the mutant ORF2 polypeptides disclosed herein have an enzymatic activity higher than WT ORF2, wherein the mutant ORF2 polypeptides use OA as substrate and GPP as donor. In some aspects, the mutant ORF2 polypeptides disclosed herein have an activity that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the enzymatic activity of WT ORF2, wherein the mutant ORF2 polypeptides use OA as substrate and GPP as donor.

In some aspects, the mutant ORF2 polypeptides disclosed herein produce a higher % of CBGA than the WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of CBGA than WT ORF2.

In some aspects, the mutant ORF2 polypeptides disclosed herein produce a lower % of CBGA than the WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, or about 100%), inclusive all the values and subranges that lie therebetween, lower % of CBGA than WT ORF2.

In some aspects, the mutant ORF2 polypeptides disclosed herein produce a higher % of 5-GOA than WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of 5-GOA than the WT ORF2.

In some aspects, the mutant ORF2 polypeptides disclosed herein produce a lower % of 5-GOA than WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, about 100%), inclusive all the values and subranges that lie therebetween, lower % of 5-GOA than the WT ORF2.

In some aspects, the mutant ORF2 polypeptides disclosed herein have a CBGA production potential that is higher than that of WT ORF2. As used herein, CBGA production potential of an enzyme is calculated by multiplying the % CBGA in total prenylated products by the % activity calculated when the mutant ORF-2 uses OA as substrate and GPP as donor. In some aspects, the mutant ORF2 polypeptides disclosed herein have a CBGA production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

In some aspects, the mutant ORF2 polypeptides disclosed herein produce a lower % of 5-GOA than WT ORF2; and have a CBGA production potential that is higher than that of WT ORF2.

In some aspects, the mutant ORF2 polypeptides disclosed herein have a 5-GOA production potential that is higher than that of WT ORF2. As used herein, 5-GOA production potential of an enzyme is calculated by multiplying the %5-GOA in total prenylated products by the % activity calculated when the mutant ORF-2 uses OA as substrate and GPP as donor. In some aspects, the mutant ORF2 polypeptides disclosed herein has a 5-GOA production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

ORF2 Mutants Catalyzing a Reaction Using DVA as Substrate

In some aspects, the mutant ORF2 polypeptides disclosed herein catalyze the reaction of converting DVA and GPP to CBGVA and 5-GDVA.

In some aspects, the mutant ORF2 polypeptides disclosed herein produce a higher amount of total nMol of prenylated products than WT ORF2, wherein the mutant ORF2 polypeptides use DVA as substrate and GPP as donor; and the prenylated products are CBGVA and 5-GDVA. In some aspects, the mutant ORF2 polypeptides disclosed herein produce an amount of total nMol of prenylated products that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the amount of total nMol of prenylated products produced by WT ORF2, wherein the prenylated products are CBGVA and 5-GDVA.

The ratio of CBGVA to 5-GDVA produced by WT ORF2 is about 16:84. In some aspects, the mutant ORF2 polypeptides disclosed herein produce a ratio of CBGVA to 5-GDVA that is higher than the ratio of CBGVA to 5-GDVA produced by WT ORF2 under the same conditions. In some aspects, the mutant ORF2 polypeptides disclosed herein produce a ratio of CBGVA to 5-GDVA that is lower than the ratio of CBGVA to 5-GDVA produced by WT ORF2 under the same conditions. In some embodiments, the ratio of CBGVA to 5-GDVA produced by the mutant ORF2 proteins of this disclosure may range from about 1:99 to up to about 16:84; or more than about 16:84 to about 99:1, for example about 5:95, about 10:90, about 15:85, about 20:80, about 25:75, about 30:70, about 35:65, about 40:60, about 45:55, about 50:50, about 55:45, about 60:40, about 65:35, about 70:30, about 75:25, about 80:20, about 85:15, about 90:10, about 95:5, or about 99:1, including all values and subranges that lie therebetween.

In some aspects, the mutant ORF2 polypeptides disclosed herein have an enzymatic activity higher than WT ORF2, wherein the mutant ORF2 polypeptides use DVA as substrate and GPP as donor. In some aspects, the mutant ORF2 polypeptides disclosed herein have an activity that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the enzymatic activity of WT ORF2, wherein the mutant ORF2 polypeptides use DVA as substrate and GPP as donor.

In some aspects, the mutant ORF2 polypeptides disclosed herein produce a higher % of CBGVA than the WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of CBGVA than WT ORF2.

In some aspects, the mutant ORF2 polypeptides disclosed herein produce a lower % of CBGVA than the WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, or about 100%), inclusive all the values and subranges that lie therebetween, lower % of CBGVA than WT ORF2.

In some aspects, the mutant ORF2 polypeptides disclosed herein produce a higher % of 5-GDVA than WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of 5-GDVA than the WT ORF2.

In some aspects, the mutant ORF2 polypeptides disclosed herein produce a lower % of 5-GDVA than WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, about 100%), inclusive all the values and subranges that lie therebetween, lower % of 5-GDVA than the WT ORF2.

In some aspects, the mutant ORF2 polypeptides disclosed herein have a CBGVA production potential is higher than that of WT ORF2. As used herein, CBGVA production potential of an enzyme is calculated by multiplying the % CBGVA in total prenylated products by the % activity calculated when the mutant ORF-2 uses DVA as substrate and GPP as donor. In some aspects, the mutant ORF2 polypeptides disclosed herein have a CBGVA production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

In some aspects, the mutant ORF2 polypeptides disclosed herein produce a lower % of 5-GDVA than WT ORF2; and have a CBGVA production potential that is higher than that of WT ORF2.

In some aspects, the mutant ORF2 polypeptides disclosed herein have a 5-GDVA production potential that is higher than that of WT ORF2. As used herein, 5-GDVA production potential of an enzyme is calculated by multiplying the %5-GDVA in total prenylated products by the % activity calculated when the mutant ORF-2 uses DVA as substrate and GPP as donor. In some aspects, the mutant ORF2 polypeptides disclosed herein has a 5-GDVA production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

ORF2 Mutants Catalyzing a Reaction Using O as Substrate

In some aspects, the mutant ORF2 polypeptides disclosed herein catalyze the reaction of converting 0 and GPP to CBG and 5-GO. See FIG. 118, showing that ORF2 substrates include benzoic acids and benzenediols.

In some aspects, the mutant ORF2 polypeptides disclosed herein produce a higher amount of total nMol of prenylated products than WT ORF2, wherein the mutant ORF2 polypeptides use O as substrate and GPP as donor; and the prenylated products are CBG and 5-GO. In some aspects, the mutant ORF2 polypeptides disclosed herein produce an amount of total nMol of prenylated products that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the amount of total nMol of prenylated products produced by WT ORF2, wherein the prenylated products are CBG and 5-GO.

The ratio of CBG to 5-GO produced by WT ORF2 is about 62:38. In some aspects, the mutant ORF2 polypeptides disclosed herein produce a ratio of CBG to 5-GO that is higher than the ratio of CBG to 5-GO produced by WT ORF2 under the same conditions. In some aspects, the mutant ORF2 polypeptides disclosed herein produce a ratio of CBG to 5-GO that is lower than the ratio of CBG to 5-GO produced by WT ORF2 under the same conditions. In some embodiments, the ratio of CBG to 5-GO produced by the mutant ORF2 proteins of this disclosure may range from about 99:1 to up to about 62:38; or less than about 62:38 to about 1:99, for example about 5:95, about 10:90, about 15:85, about 20:80, about 25:75, about 30:70, about 35:65, about 40:60, about 45:55, about 50:50, about 55:45, about 60:40, about 65:35, about 70:30, about 75:25, about 80:20, about 85:15, about 90:10, about 95:5, or about 99:1, including all values and subranges that lie therebetween.

In some aspects, the mutant ORF2 polypeptides disclosed herein have an enzymatic activity higher than WT ORF2, wherein the mutant ORF2 polypeptides use 0 as substrate and GPP as donor. In some aspects, the mutant ORF2 polypeptides disclosed herein have an activity that is about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than the enzymatic activity of WT ORF2, wherein the mutant ORF2 polypeptides use 0 as substrate and GPP as donor.

In some aspects, the mutant ORF2 polypeptides disclosed herein produce a higher % of CBG than the WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of CBG than WT ORF2.

In some aspects, the mutant ORF2 polypeptides disclosed herein produce a lower % of CBG than the WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, or about 100%), inclusive all the values and subranges that lie therebetween, lower % of CBG than WT ORF2.

In some aspects, the mutant ORF2 polypeptides disclosed herein produce a higher % of 5-GO than WT ORF2. In some aspects, the mutant ORF2 polypeptides disclosed herein produce about 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher % of 5-GO than the WT ORF2.

In some aspects, the mutant ORF2 polypeptides disclosed herein produce a lower % of 5-GO than WT ORF2. In some aspects, the mutant ORF2 polypeptides disclosed herein produce about 1% to about 100% (for example, about 1%, about 5%, about 10%, about 20%, about 30%, about 40%, about 50%, about 60%, about 70%, about 80%, about 90%, about 100%), inclusive all the values and subranges that lie therebetween, lower % of 5-GO than the WT ORF2.

In some aspects, the mutant ORF2 polypeptides disclosed herein have a CBG production potential is higher than that of WT ORF2. As used herein, CBG production potential of an enzyme is calculated by multiplying the % CBG in total prenylated products by the % activity calculated when the mutant ORF-2 uses 0 as substrate and GPP as donor. In some aspects, the mutant ORF2 polypeptides disclosed herein have a CBG production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

In some aspects, the mutant ORF2 polypeptides disclosed herein produce a lower % of 5-GO than WT ORF2; and have a CBG production potential that is higher than that of WT ORF2.

In some aspects, the mutant ORF2 polypeptides disclosed herein have a 5-GO production potential is higher than that of WT ORF2. As used herein, 5-GO production potential of an enzyme is calculated by multiplying the %5-GO in total prenylated products by the % activity calculated when the mutant ORF-2 uses 0 as substrate and GPP as donor. In some aspects, the mutant ORF2 polypeptides disclosed herein has a 5-GO production potential that is 1% to about 1000% (for example, about 1%, about 5%, about 10%, about 20%, about 30%, about 40%, about 50%, about 60%, about 70%, about 80%, about 90%, about 100%, about 150%, about 200%, about 300%, about 400%, about 500%, about 600%, about 700%, about 800%, or about 900%), inclusive all the values and subranges that lie therebetween, higher than that of WT ORF2.

ORF2 Mutants Catalyzing a Reaction at pH 5.3

In some aspects, the ORF2 mutants disclosed herein have improved function at a pH range of about 3 to about 8, for instance, about 3.5, about 4, about 4.5 about 5, about 5.5, about 6, about 6.5, about 7, about 7.5, about 8, including all values and subranges therebetween. In some aspects, the ORF2 mutants disclosed herein which have improved function at acidic pH may be used in combination with at least one other enzyme which has optimal function at acidic pH. In some aspects, the at least one enzyme is CBD synthase.

In some aspects, the mutant ORF2 polypeptides disclosed herein have improved enzymatic function (increased amount of prenylated products, increased % CBGA or 5-GOA produced, increased % activity and/or increased CBGA or 5-GOA production potential) at pH 5.3 compared to WT ORF2 at the same pH. WT ORF2 has little to no activity at this acidic pH. Therefore, in some aspects, the ORF2 mutants disclosed herein which have improved function at pH 5.3 may be used in situations where a low pH is needed to be maintained. For instance, CBD synthase has optimal pH at around 5.3. Therefore, the ORF2 mutants disclosed herein which have improved function at pH 5.3 may be used for carrying out single-pot reactions along with CBD synthase.

Polynucleotides, Vectors and Methods

The disclosure provides isolated or purified polynucleotides that encode any one of the ORF2 mutant polypeptides disclosed herein. The disclosure provides polynucleotides comprising a nucleic acid sequence with at least about 80% identity (for instance, about 85%, about 90%, about 95%, about 96%, about 97%, about 98%, or about 99%, and inclusive of all values and subranges therebetween) to the nucleic acid sequence set forth in [[all the DNA SEQ ID Nos.]].

The disclosure provides a vector comprising any one of the ORF2 mutant polynucleotide sequences disclosed herein.

The disclosure further provides a host cell comprising any one of the vectors disclosed herein; any one of the polynucleotides disclosed herein; or any one of the polynucleotides encoding the ORF2 mutants disclosed herein. Non-limiting examples of host cells include microbial host cells, such as, for example, bacteria, E. coli, yeast, microalgae; non-microbial hosts, such as, for example, insect cells, mammalian cell culture, plant cultures; and whole terrestrial plants. In some aspects, expression of any one of the vectors disclosed herein; any one of the polynucleotides disclosed herein; or any one of the polynucleotides encoding the ORF2 mutants disclosed herein may be done ex vivo or in vitro. In some aspects, expression of any one of the vectors disclosed herein; any one of the polynucleotides disclosed herein; or any one of the polynucleotides encoding the ORF2 mutants disclosed herein may be done in cell-free systems.

The disclosure provides methods of producing any one of the mutant ORF2 polypeptides disclosed herein, comprising culturing the host cell comprising any one of the vectors disclosed herein, in a medium permitting expression of the mutant ORF2 polypeptide, and isolating or purifying the mutant ORF2 polypeptide from the host cell.

The disclosure provides methods of producing CBGA in a host cell, comprising expressing a mutant ORF2 polypeptide, wherein the mutant ORF2 polypeptide has a CBGA production potential that is higher than that of WT ORF2, and wherein the mutant ORF2 polypeptide produces a lower % of 5-GOA than WT ORF2. In some aspects, the CBGA is produced ex vivo or in vitro. In some aspects, CBGA is produced in cell-free systems. In some aspects, the CBGA is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the CBGA is produced in the medium of host cell culture.

The disclosure provides methods of producing 5-GOA in a host cell, comprising expressing a mutant ORF2 polypeptide, wherein the mutant ORF2 polypeptide has a 5-GOA production potential that is higher than that of WT ORF2, and wherein the mutant ORF2 polypeptide produces a lower % of CBGA than WT ORF2. In some aspects, the 5-GOA is produced ex vivo or in vitro. In some aspects, 5-GOA is produced in cell-free systems. In some aspects, the 5-GOA is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the 5-GOA is produced in the medium of host cell culture.

The disclosure provides methods of producing CBGVA in a host cell, comprising expressing a mutant ORF2 polypeptide, wherein the mutant ORF2 polypeptide has a CBGVA production potential that is higher than that of WT ORF2, and wherein the mutant ORF2 polypeptide produces a lower % of 5-GDVA than WT ORF2. In some aspects, the CBGVA is produced ex vivo or in vitro. In some aspects, CBGVA is produced in cell-free systems. In some aspects, the CBGVA is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the CBGVA is produced in the medium of host cell culture.

The disclosure provides methods of producing 5-GDVA in a host cell, comprising expressing a mutant ORF2 polypeptide, wherein the mutant ORF2 polypeptide has a 5-GDVA production potential that is higher than that of WT ORF2, and wherein the mutant ORF2 polypeptide produces a lower % of CBGVA than WT ORF2. In some aspects, the 5-GDVA is produced ex vivo or in vitro. In some aspects, 5-GDVA is produced in cell-free systems. In some aspects, the 5-GDVA is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the 5-GDVA is produced in the medium of host cell culture.

The disclosure provides methods of producing CBG in a host cell, comprising expressing a mutant ORF2 polypeptide, wherein the mutant ORF2 polypeptide has a CBG production potential that is higher than that of WT ORF2, and wherein the mutant ORF2 polypeptide produces a lower % of 5-GO than WT ORF2. In some aspects, the CBG is produced ex vivo or in vitro. In some aspects, CBG is produced in cell-free systems. In some aspects, the CBG is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the CBG is produced in the medium of host cell culture.

The disclosure provides methods of producing 5-GO in a host cell, comprising expressing a mutant ORF2 polypeptide, wherein the mutant ORF2 polypeptide has a 5-GO production potential that is higher than that of WT ORF2, and wherein the mutant ORF2 polypeptide produces a lower % of CBG than WT ORF2. In some aspects, the 5-GO is produced ex vivo or in vitro. In some aspects, 5-GO is produced in cell-free systems. In some aspects, the 5-GO is produced in host cells, such as, for example, microbial host cells, such as, for example, bacteria, E. coli, yeast, microalgae; non-microbial hosts, such as, for example, insect cells, mammalian cells, plant cells; and whole terrestrial plants. In some aspects, the 5-GO is produced in the medium of host cell culture.

It is to be understood that the description above as well as the examples that follow are intended to illustrate, and not limit, the scope of the invention. Other aspects, advantages and modifications within the scope of the invention will be apparent to those skilled in the art to which the invention pertains.

All patents, patent applications, references, and journal articles cited in this disclosure are expressly incorporated herein by reference in their entireties for all purposes.

EXAMPLES

Example 1: Methods for Generating and Studying ORF2 Variants

A. Construction of a Synthesized Gene Library of n=96 Orf2 Variants with Select Amino Acid Substitutions and Other Orf2 Variants.

DNA plasmids encoding the 96 "tripleton" variants of orf2 (orf2 variants) were ordered and delivered in the background of the T5 expression vector pD441-SR from DNA2.0 (now ATUM, catalog pD441-SR). The sequences for the 96 variants are described as SEQ ID NO: DNA_150247-DNA_150342. Each Orf2 variant contains a unique combination of three amino acid substitutions relative to the base construct (SEQ ID NO: DNA_consensus).

All variants aside from the tripleton parental variants were created using site directed mutagenesis with QuikChange II Site-Directed Mutagenesis Kit (Agilent catalog #200523). Standard manufacturer protocols were employed.

B. Expression and Purification of Proteins from the Synthesized Orf2 Gene Library of Orf2 Variants.

DNA plasmids containing each of the Orf2 variants were individually transformed into OneShot BL21(DE3) chemically competent *E. coli* cells (Invitrogen catalog C600003) according to the chemically competent cell transformation protocol provided by Invitrogen. This resulted in 96 individual *E. coli* cell lines, each containing one plasmid encoding an Orf2 variant.

To induce protein expression, individual cell lines encoding each of the "orf2 variants" was individually inoculated into 2 milliliters LB media with 50 micrrograms per milliliter of Kanamycin sulfate in 15 milliliter culture tubes and grown at 37 degrees Celsius for 16 hours with vigorous shaking. After 16 hours, each culture was diluted into 38 milliliters LB media with 50 micrograms per milliliter of Kanamycin sulfate for a total of 40 milliliters. The absorbance at 600 nm (0D600) was monitored until it reached a value of 0.6 absorbance units. When the OD600 reached a value of 0.6, then IPTG was added to each culture to a final concentration of 500 micrograms per milliliter, resulting in an "induced culture." Each "induced culture" was grown at 20 degrees Celsius with vigorous shaking for 20 hours.

After the cultures were grown under protein induction conditions, the target protein was extracted following a standard protein purification protocol. Each "induced culture" was spun at 4,000G for 5 minutes. The supernatant was discarded, leaving only a cell pellet. Each individual cell pellet was resuspended in 25 milliliters of a solution containing 20 millimolar Tris-HCL, 500 millimolar sodium chloride, 5 millimolar imidazole, and 10% glycerol ("lysis buffer"), resulting in a "cell slurry." To each individual "cell slurry", 30 microliters of 25 units per microliter Benzonase (Millipore, Benzonase, catalog number 70664-1), as well as 300 microliters of phosphatase and protease inhibitor (Thermo-Fisher, Halt Protease and Phosphatase Inhibitor Cocktail, EDTA-free, catalog number 78441) was added. Each individual "cell slurry" was then subjected to 30 second pulses of sonication, 4 times each, for a total of 120 seconds, using the Fisher Scientific Sonic Dismembrator Model 500 under 30% amplitude conditions. In between each 30 second pulse of sonication, the "cell slurry" was placed on ice for 30 seconds. After sonication, each individual "cell slurry" was centrifuged for 45 minutes at 14,000 times gravity.

Protein purification columns (Bio-Rad, Econo-Pac Chromotography Columns, catalog number 7321010) were prepared by adding 1.5 milliliters His60 resin slurry (Takara, His60 nickel superflow resin, catalog number 635660). 5 milliliters deionized water was added to resin slurry, to agitate and rinse the resin. The columns were then uncapped and the resulting flow-through was discarded. Then, 5 milliliters deionized water was added a second time, and the resulting flow-through was discarded. Then, 10 milliliters "lysis buffer" was added to the resin, completely disturbing the resin bed, and the flow-through was discarded.

The protein purification columns were capped, and the supernatant from the "cell slurry" was added to the resin bed without disturbing the resin bed. The columns were uncapped, allowing the supernatant to pass over the resin bed. The resin was then washed 2 times with 10 milliliters of a solution containing 20 millimolar Tris-HCl, 500 millimolar sodium chloride, and 20 millimolar imidazole ("wash buffer"). The flow-through from the wash steps was discarded. The protein was then eluted off the column with 10 milliliters of a solution containing 20 millimolar Tris-HCl, 200 millimolar sodium chloride, and 250 millimolar imidazole. The eluted protein was collected and dialyzed overnight in 4 liters of a solution containing 200 millimolar Tris-HCl and 800 millimolar sodium chloride in 3.5-5.0 kilodalton dialysis tubing (Spectrum Labs, Spectra/Por dialysis tubing, catalog number 133198). After overnight dialysis, protein was concentrated to approximately 10 milligrams per milliliter using centrifugal protein filters (Millipore Amicon Ultra-15 Ultracel 10K, catalog number UFC901024).

C. Screening of the Orf2 Protein Variants for Protein Activity and Phenotypes.

The library of orf2 variants were screened for protein expression by western blot with an anti-HIS antibody (Cell Signaling Technologies, anti-his monoclonal antibody, catalog number 23655) according to the protocol provided by Cell Signaling Technologies for the antibody. The variants that had detectable levels of protein expression as determined by western blot were used in a prenylation assay.

Proteins that exhibited detectable expression by Western blot were assayed for prenylation activity using a substrate (e.g. olivetolic acid, olivetol, divarinic acid, etc.) and a donor molecule (e.g. GPP, FPP, DMAPP, etc.). Unless otherwise stated, each prenylation reaction assay was performed in a volume of 20 microliters and contained 20 millimolar magnesium chloride (MgCl2), 2 millimolar donor molecule (e.g. GPP), 100 millimolar HEPES buffer at a pH of 7.5, 2 millimolar substrate (e.g. olivetolic acid), and 20 micrograms Orf2 protein or Orf2 variant protein. These reactions were incubated for 16 hours at 30° C.

For those prenylation reactions carried out at pH 5.3, the same prenylation reaction assay protocol above was carried out with the exception of replacing HEPES buffer with sodium citrate at pH 5.3.

To assess prenylation activity by HPLC the prenylation products were extracted from the assay reaction with the following protocol: 40 microliters of ethyl acetate was added to each reaction and vortexed thoroughly. After vortexing, each reaction was centrifuged for 10 minutes at 14,000G. The top layer ("organic layer") was collected. This was repeated twice. The collected organic layer was evaporated, and the resulting residue was resuspended in 40 microliters of 100% methanol. After resuspending in methanol, 40 microliters of 100% HPLC grade water was added to bring the final solution to 50% methanol. These will be referred to as the "variant reactions with GPP."

The final 50% methanol solutions were run on a Thermo Fisher UltiMate 3000 UHPLC with an Acclaim RSLC 120 angstrom C18 column with a 4 millimeter Phenomonex Securityguard guard column (54 millimeter total column length).

The wild type Orf2 standard prenylation assay produces two products as determined by HPLC, with retention times of approximately 6.9 minutes (an "early product" which is cannabigerolic acid [CBGA]) and 7.2 minutes (a "late product" 5-GOA) in a ratio of ~20% CBGA to 80% 5-GOA.

Example 2: Generation of ORF2 Variants which Synthesize an Altered Amount of CBGA and/or 5-GOA, Compared to WT ORF2

A rational design approach was used to generate a library of 96 ORF2 triple mutants in which each triple mutant carried amino acid substitutions at 3 of 36 selected residues following the methods described in Example 1. These triple mutants may be interchangeably referred to as tripleton variants or tripleton mutants. Each amino acid substitution was employed 3-5 times in the library. From 66 of the 96 clones each carrying a unique tripleton ORF2 variant, ORF2 mutant proteins were expressed and their activity was analyzed as described in Example 1.

Table 1 provides a summary of the analysis performed on the enzymatic activity of the ORF2 variants to produce CBGA and 5-GOA using Olivetolic Acid (OA) as substrate and Geranyl pyrophosphate (GPP) as donor. Table 1 lists the mutations within each of the tripleton mutants as well the nMol of CBGA produced, nMol of 5-GOA produced, total prenylated products produced (nMol of CBGA+5-GOA), % CBGA within total prenylated products (nMol of CBGA/ [nMol of CBGA+5-GOA]), % enzymatic activity (total prenylated products produced by a mutant/total prenylated products produced by wild-type ORF2), CBGA production (% CBGA among total prenylated products*% enzymatic activity), and %5-GOA within prenylated products (nMol of 5-GOA/[nMol of CBGA+5-GOA]) for each of the ORF2 variants.

TABLE 1

Analysis of ORF2 mutants and WT ORF2 based on production of CBGA from OA and GPP

| Ser. No. | CLONE | Mutations | nMol CBGA | nMol 5-GOA | Total Product | % CBGA | % Activity | CBGA Production (% CBGA * % activity) | % 5-GOA |
|---|---|---|---|---|---|---|---|---|---|
| n/a | WT | WT | 1.693073479 | 6.906720359 | 8.599793838 | 19.7% | 100.0% | 0.2 | 80.31% |
| 1 | F08 | A53T_N173D_S214R | 0.696655254 | 0.019606549 | 0.716261803 | 97.3% | 8.6% | 0.1 | 2.7% |
| 2 | G12 | A17T_Q161W_A232S | 6.109902555 | 0.614932664 | 6.724835219 | 90.9% | 78.2% | 0.7 | 9.1% |
| 3 | G11 | S177W_Y288H_V294N | 0.145430603 | 0.029376815 | 0.174807419 | 83.2% | 2.0% | 0.0 | 16.8% |
| 5 | H02 | A53Q_S177W_L219F | 3.42156966 | 1.080670716 | 4.502240376 | 76.0% | 52.4% | 0.4 | 24.0% |
| 6 | H06 | V49L_E112D_G286E | 0.070345009 | 0.025481912 | 0.095826921 | 73.4% | 1.1% | 0.0 | 26.6% |
| 8 | A04 | L219F_V294N_Q295A | 3.234527258 | 1.296738843 | 4.531266102 | 71.4% | 40.6% | 0.3 | 28.6% |
| 10 | C03 | V49L_S214R_V271E | 0.048617329 | 0.024425667 | 0.073042996 | 66.6% | 0.8% | 0.0 | 33.4% |
| 11 | F09 | Q38G_D166E_Q295A | 0.915880959 | 0.48336414 | 1.399245099 | 65.5% | 16.8% | 0.1 | 34.5% |
| 13 | H05 | S177E_S214R_R228E | 0.039715565 | 0.022115131 | 0.061830696 | 64.2% | 0.7% | 0.0 | 35.8% |
| 14 | G09 | M106E_G205L_C209G | 0.026257572 | 0.016437814 | 0.042695385 | 61.5% | 0.5% | 0.0 | 38.5% |
| 15 | G07 | V49S_Y216A_V294N | 0.503397419 | 0.325323475 | 0.828720894 | 60.7% | 9.6% | 0.1 | 39.3% |
| 16 | A11 | V49L_D166E_L274V | 0.028022123 | 0.018946396 | 0.046968518 | 59.7% | 0.4% | 0.0 | 40.3% |
| 17 | C10 | A53Q_L274V_Q295A | 0.157229392 | 0.108397148 | 0.26562654 | 59.2% | 2.8% | 0.0 | 40.8% |
| 18 | D11 | F123H_L174V_S177E | 0.573031341 | 0.397874307 | 0.970905647 | 59.0% | 11.7% | 0.1 | 41.0% |
| 19 | B11 | V49S_K119D_F213M | 0.029022913 | 0.020200687 | 0.049223599 | 59.0% | 0.5% | 0.0 | 41.0% |
| 20 | B10 | M106E_Y121W_D166E | 0.032314986 | 0.023237391 | 0.055552377 | 58.2% | 0.6% | 0.0 | 41.8% |
| 21 | G10 | V49A_Y121W_C230S | 0.0186463 | 0.013731186 | 0.032377485 | 57.6% | 0.4% | 0.0 | 42.4% |
| 22 | C05 | A53Q_S177Y_Y288H | 2.329839347 | 1.716266174 | 4.046105521 | 57.6% | 42.6% | 0.2 | 42.4% |
| 23 | C07 | V49L_K119D_G205M | 0.031761917 | 0.025613942 | 0.05737586 | 55.4% | 0.6% | 0.0 | 44.6% |
| 24 | A08 | C25V_A232S_V271E | 0.027785093 | 0.022445207 | 0.050230301 | 55.3% | 0.5% | 0.0 | 44.7% |
| 25 | C02 | K118N_K119A_V271E | 0.029312615 | 0.024755743 | 0.054068359 | 54.2% | 0.6% | 0.0 | 45.8% |
| 26 | D03 | D227E_C230N_Q295W | 0.28775349 | 0.249801954 | 0.537555444 | 53.5% | 5.7% | 0.0 | 46.5% |
| 27 | B05 | A53Q_Y121W_A232S | 0.01948907 | 0.017097967 | 0.036587037 | 53.3% | 0.4% | 0.0 | 46.7% |
| 28 | F10 | K119D_Q161W_L298Q | 0.044745852 | 0.039807235 | 0.084553087 | 52.9% | 1.0% | 0.0 | 47.1% |
| 29 | C06 | Q161A_M162F_Q295A | 0.926020543 | 0.852983892 | 1.779004435 | 52.1% | 18.7% | 0.1 | 47.9% |
| 30 | E09 | A53T_M106E_Q161S | 5.187648143 | 5.017560074 | 10.20520822 | 50.8% | 122.8% | 0.6 | 49.2% |
| 31 | A03 | F123A_Y283L | 0.051777719 | 0.05017164 | 0.101949359 | 50.8% | 0.9% | 0.0 | 49.2% |
| 32 | A10 | V49S_K118Q_S177E | 0.382933895 | 0.46547399 | 0.848407885 | 45.1% | 7.6% | 0.0 | 54.9% |
| 33 | A12 | Y121W_S177Y_G286E | 0.011983145 | 0.014853446 | 0.026836591 | 44.7% | 0.2% | 0.0 | 55.3% |
| 34 | B02 | V49A_S177Y_C209G | 0.025283118 | 0.031621336 | 0.056904454 | 44.4% | 0.6% | 0.0 | 55.6% |
| 35 | B06 | D166E_S177Y_S214F | 0.024782723 | 0.033997888 | 0.058780611 | 42.2% | 0.6% | 0.0 | 57.8% |
| 36 | H11 | A108G_Q161S_G205M | 2.068317092 | 2.915368365 | 4.983685458 | 41.5% | 58.0% | 0.2 | 58.5% |
| 37 | D10 | V49A_F123A_Y288H | 0.010034238 | 0.015117507 | 0.025151745 | 39.9% | 0.3% | 0.0 | 60.1% |
| 38 | A09 | V49A_Q161S_V294A | 3.196576244 | 4.907578538 | 8.104154803 | 39.4% | 72.7% | 0.3 | 60.6% |
| 39 | D04 | A53T_D166E_Q295W | 2.748485647 | 4.298125165 | 7.046610812 | 39.0% | 74.2% | 0.3 | 61.0% |
| 40 | E10 | E112D_K119A_N173D | 0.066631551 | 0.108199102 | 0.174830653 | 38.1% | 2.1% | 0.0 | 61.9% |
| 41 | F12 | A17T_V49A_C230N | 0.043402686 | 0.087998416 | 0.131401102 | 33.0% | 1.5% | 0.0 | 67.0% |
| 42 | C09 | A108G_K119D_L298A | 0.03605478 | 0.074993398 | 0.111048179 | 32.5% | 1.2% | 0.0 | 67.5% |
| 43 | H01 | K119A_Q161A_R228Q | 0.057018699 | 0.121006073 | 0.178024772 | 32.0% | 2.1% | 0.0 | 68.0% |
| 44 | H04 | M162A_C209G_Y288H | 0.061917303 | 0.154673884 | 0.216591187 | 28.6% | 2.5% | 0.0 | 71.4% |
| 45 | G06 | K118Q_F123A_R228E | 0.020437187 | 0.051491946 | 0.071929133 | 28.4% | 0.8% | 0.0 | 71.6% |
| 46 | B04 | A53E_A108G_K118N | 0.020779563 | 0.052812252 | 0.073591815 | 28.2% | 0.8% | 0.0 | 71.8% |
| 47 | D01 | K118Q_Q161W_S214F | 0.095601791 | 0.258515976 | 0.354117767 | 27.0% | 3.7% | 0.0 | 73.0% |
| 48 | A07 | G205L_R228E_C230N | 0.020700553 | 0.064562799 | 0.085263532 | 24.3% | 0.8% | 0.0 | 75.7% |
| 49 | D09 | K118N_C209G_R228Q | 0.008954438 | 0.028122524 | 0.037076962 | 24.2% | 0.4% | 0.0 | 75.8% |
| 50 | B09 | C25V_F213M_Y216A | 0.07951014 | 0.260364405 | 0.339874544 | 23.4% | 3.6% | 0.0 | 76.6% |
| 51 | G04 | D227E_R228E_L298Q | 0.015591256 | 0.056443095 | 0.072034351 | 21.6% | 0.8% | 0.0 | 78.4% |
| 52 | B08 | K118Q_L174V_R228Q | 0.044903871 | 0.167216794 | 0.212120666 | 21.2% | 2.2% | 0.0 | 78.8% |
| 54 | G05 | A53T_K118N_S214F | 0.581906769 | 2.595176945 | 3.177496945 | 18.3% | 36.9% | 0.1 | 81.7% |
| 55 | B12 | A17T_F123W_L298Q | 0.125256782 | 0.602523739 | 0.727580521 | 17.2% | 7.7% | 0.0 | 82.8% |
| 56 | A05 | A17T_C25V_E112G | 0.964577298 | 6.867309216 | 7.831886514 | 12.3% | 70.3% | 0.1 | 87.7% |
| 57 | C08 | V49S_S214G_V294A | 0.390782196 | 3.025481912 | 3.416264108 | 11.4% | 36.0% | 0.0 | 88.6% |
| 58 | C11 | E112D_L219F_V294F | 0.971214116 | 7.558225508 | 8.529439625 | 11.4% | 89.8% | 0.1 | 88.6% |
| 59 | A02 | Q38G_E112D_F123H | 0.271319463 | 3.467916557 | 3.739236019 | 7.3% | 33.5% | 0.0 | 92.7% |
| 60 | D08 | E112D_K119A_N173D | 0.003976824 | 0.051557961 | 0.055534785 | 7.2% | 0.7% | 0.0 | 92.8% |

TABLE 1-continued

Analysis of ORF2 mutants and WT ORF2 based on production of CBGA from OA and GPP

| Ser. No. | CLONE | Mutations | nMol CBGA | nMol 5-GOA | Total Product | % CBGA | % Activity | CBGA Production (% CBGA * % activity) | % 5-GOA |
|---|---|---|---|---|---|---|---|---|---|
| 61 | D12 | A53T_E112D_G205M | 1.387332104 | 23.71798257 | 25.10531468 | 5.5% | 302.1% | 0.2 | 94.5% |
| 62 | G03 | L219F_Y283L_L298W | 0.286120622 | 5.898930552 | 6.185051173 | 4.6% | 71.9% | 0.0 | 95.4% |
| 63 | H10 | M162A_N173D_S214F | 0.189544377 | 3.951874835 | 4.141419212 | 4.6% | 48.2% | 0.0 | 95.4% |
| 64 | H09 | E112G_G205M_L298W | 0.422149065 | 13.32116451 | 13.74331358 | 3.1% | 159.8% | 0.0 | 96.9% |
| 65 | C01 | V49S_M162A_Y283L | 0.08967606 | 2.97900713 | 3.06868319 | 2.9% | 32.3% | 0.0 | 97.1% |
| 66 | D06 | A53E_Q161A_V294N | 0.453779299 | 16.8069052 | 17.2606845 | 2.6% | 181.7% | 0.0 | 97.4% |
| 67 | H07 | F123A_M162F_S214G | 0.049749802 | 1.903023501 | 1.952773304 | 2.5% | 22.7% | 0.0 | 97.5% |
| 68 | G02 | A53E_F213M_R228Q | 0.056544641 | 2.991418009 | 3.047962649 | 1.9% | 35.4% | 0.0 | 98.1% |
| 69 | C12 | N173D_F213M_V294F | 0.051988412 | 6.831726961 | 6.883715373 | 0.8% | 72.4% | 0.0 | 99.2% |
| 70 | D07 | K119A_S214G_L298A | 0.037266263 | 6.776340111 | 6.813606374 | 0.5% | 82.0% | 0.0 | 99.5% |

The amount of CBGA or 5-GOA (in nMols) generated by each of the ORF2 triple mutant clones was measured using HPLC. FIG. 1 shows the total nMols of prenylated products generated using OA as substrate and GPP as donor by each of the ORF2 triple mutants, and the proportion of CBGA and 5-GOA within the total amount of prenylated products. An exemplary Wild Type ORF2 replicate is included in the graph for comparison purposes.

Figure 2:
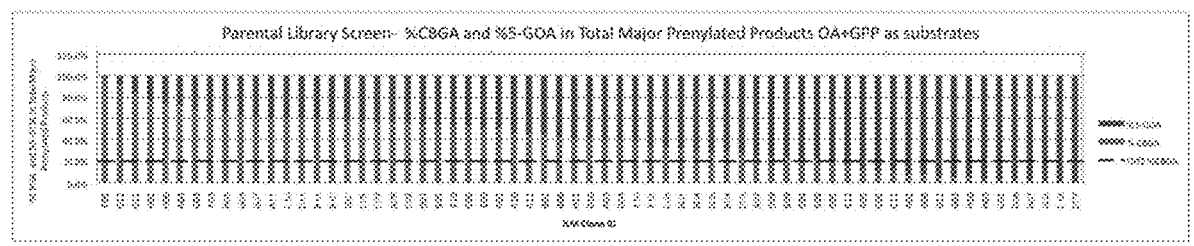
FIG. 2 shows % CBGA produced by ORF2 triple mutants using OA as substrate and GPP as donor.

FIG. 2 shows the % CBGA within the total prenylated products produced by each of the ORF2 triple mutant clones using OA as substrate and GPP as donor. In this graph, the mutant clones are ordered based on decreasing % CBGA (from left to right) they produce, with the %5-GOA depicted in red. The black threshold line on the graph indicates the % CBGA that is produced by the wild type enzyme.

Figure 3:
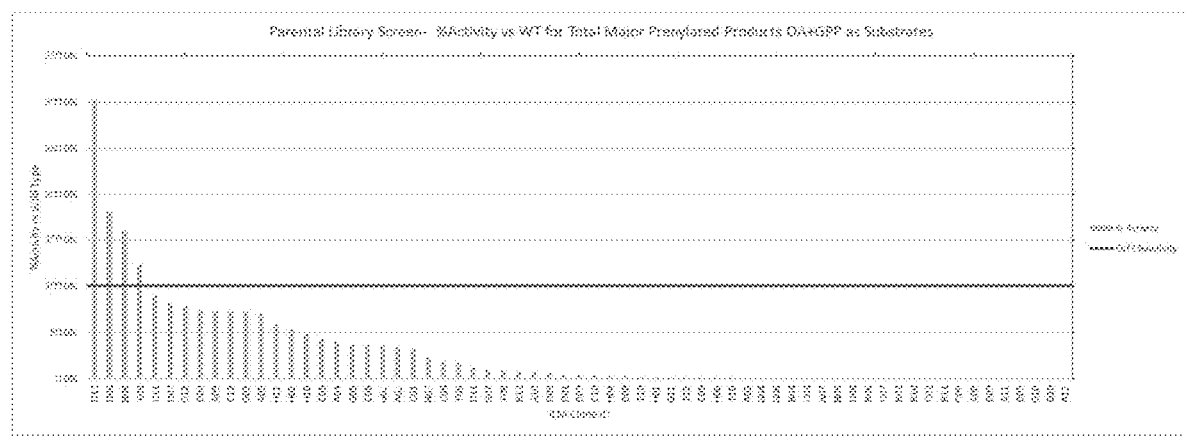
FIG. 3 shows % enzymatic activity of ORF2 triple mutants using OA as substrate and GPP as donor

FIG. 3 shows the ORF2 enzymatic activity (using OA as substrate and GPP as donor) of each of the triple mutant ORF2 clones relative to the wild type enzyme. % activity was calculated by dividing the nMols of total prenylated products produced by a mutant by the nMols of total prenylated products produced by the wild type control, and expressed as a percentage. The red threshold line is the wild type Orf2% activity.

Figure 4:
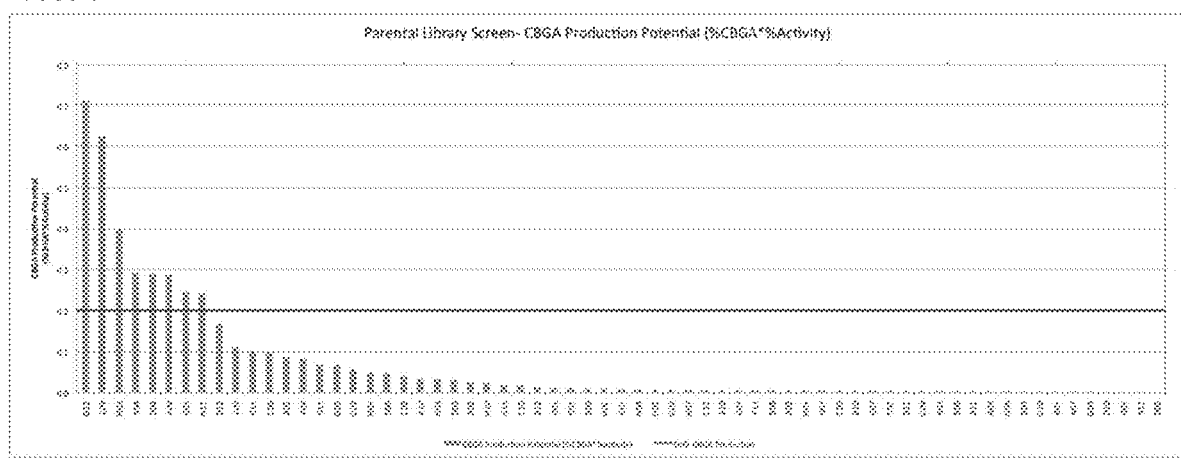
FIG. 4 shows CBGA production potential of ORF2 triple mutants using OA as substrate and GPP as donor.

FIG. 4 shows the CBGA production potential of each of the ORF2 triple mutant clones when using OA as substrate and GPP as donor. CBGA production potential (interchangeably referred to herein as CBGA production quotient) represents the improvement in CBGA production vs. the wild type enzyme. CBGA production potential was calculated by multiplying the % CBGA by the % activity of each mutant. For instance, a wild type ORF2, which makes ~20% CBGA, and has an activity of 100%, would have a CBGA Production Potential of 0.2. The red threshold line on the graph represents this wild type value of 0.2.

While the CBGA production potential analysis shown in FIG. 4 is useful to rank ORF2 mutant clones based on the amount of CBGA produced, such an analysis would not differentiate between a mutant that made 100% CBGA but was 20% as active as wild-type ORF2; or a mutant that made 10% CBGA and was 200% as active as wild type ORF2. Therefore, we employed a cluster analysis by plotting the CBGA Production Potential vs. %5-GOA (FIG. 5). %5-GOA was calculated in a similar manner as % CBGA. We used the top 16 mutants ranked based on their CBGA production potential for this analysis. High 5-GOA producing mutants cluster together towards the right of the graph and high CBGA producing mutants cluster towards the left of the graph.

Figure 5:
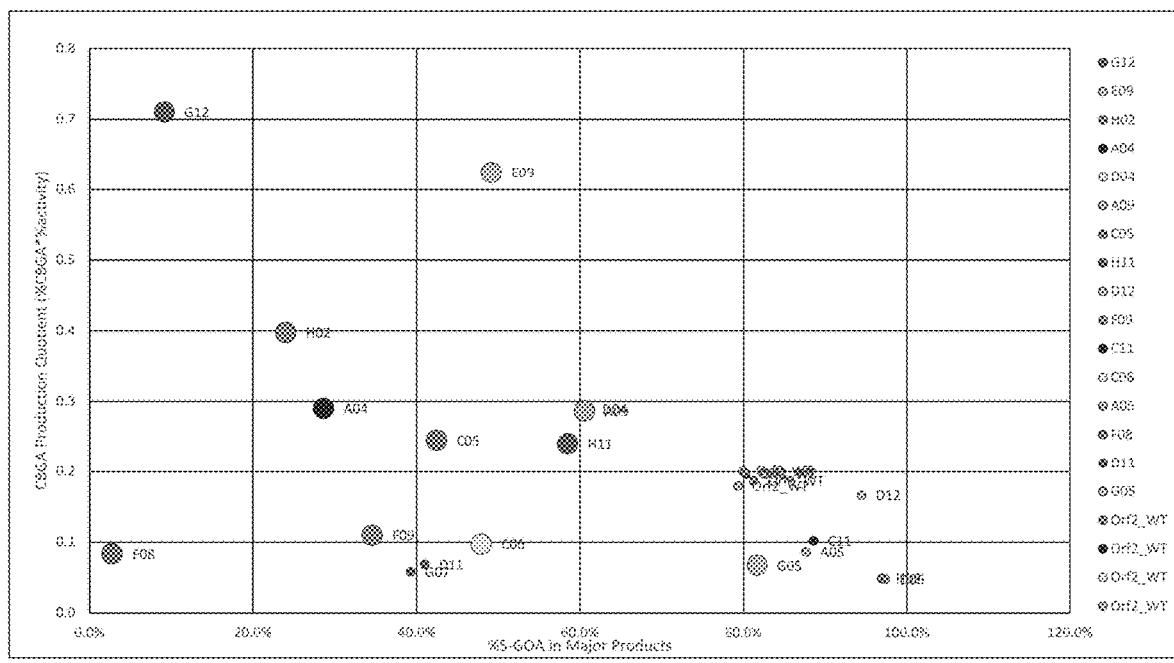
FIG. 5 shows a cluster map of ORF2 triple mutants clustered based on CBGA production potential and %5-GOA produced, using OA as substrate and GPP as donor

Based on the analysis performed in FIG. 5, 13 mutants which cluster to the left of the graph were selected (Table 2). These clones were targeted for "breakdown" analysis. Breakdown analysis involves breaking a parent triple mutant into all pair wise doubleton combinations of mutations as well as all singleton mutations that make up the parental clone. For each parental clone targeted six unique mutants are generated (3 doubles and 3 singles).

TABLE 2

| CBG Production Rank | Clone ID | Mutations |
|---|---|---|
| 1 | G12 | A17T_Q161W_A232S |
| 2 | E09 | A53T_M106E_Q161S |
| 3 | H02 | A53Q_S177W_L219F |
| 4 | A04 | L219F_V294N_Q295A |
| 5 | D04 | A53T_D166E_Q295W |
| 6 | A09 | V49A_Q161S_V294A |
| 7 | C05 | A53Q_S177Y_Y288H |
| 8 | H11 | A108G_Q161S_G205M |
| 10 | F09 | Q38G_D166E_Q295A |
| 12 | C06 | Q161A_M162F_Q295A |
| 14 | F08 | A53T_N173D_S214R |
| 15 | D11 | F123H_L174V_S177E |
| 16 | G05 | A53T_K118N_S214F |

Figure 6A:
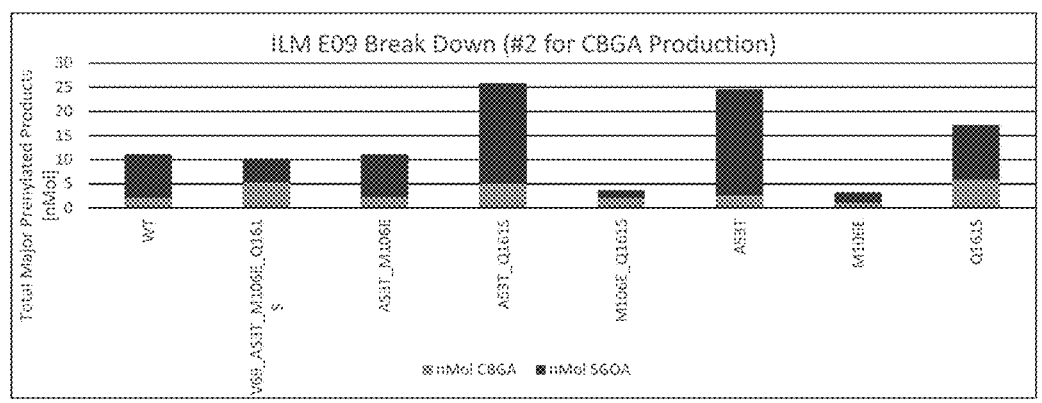
FIG. 6 shows the analysis of ORF2 enzymatic function including total nMols of prenylated products produced (FIG. 6A) and % CBGA produced (FIG. 6B) by mutants derived from the breakdown of ORF2 triple mutant clone E09.
Figure 6B:
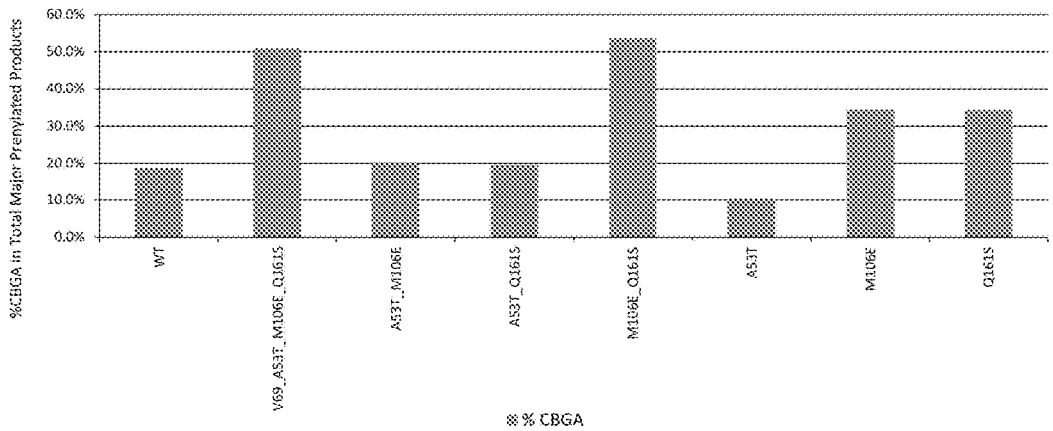
Figure 7A:
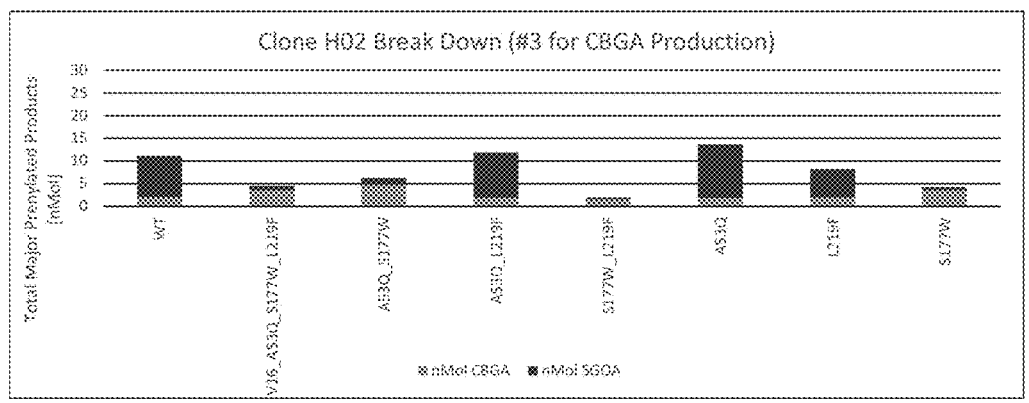
FIG. 7 shows the analysis of ORF2 enzymatic function including total nMols of prenylated products produced (FIG. 7A) and % CBGA produced (FIG. 7B) by mutants derived from the breakdown of ORF2 triple mutant clone H02.
Figure 7B:
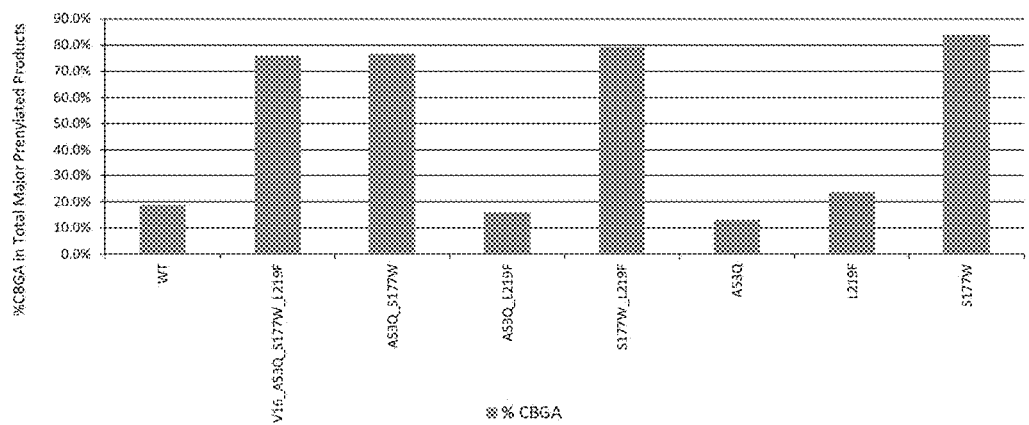
Figure 8A:
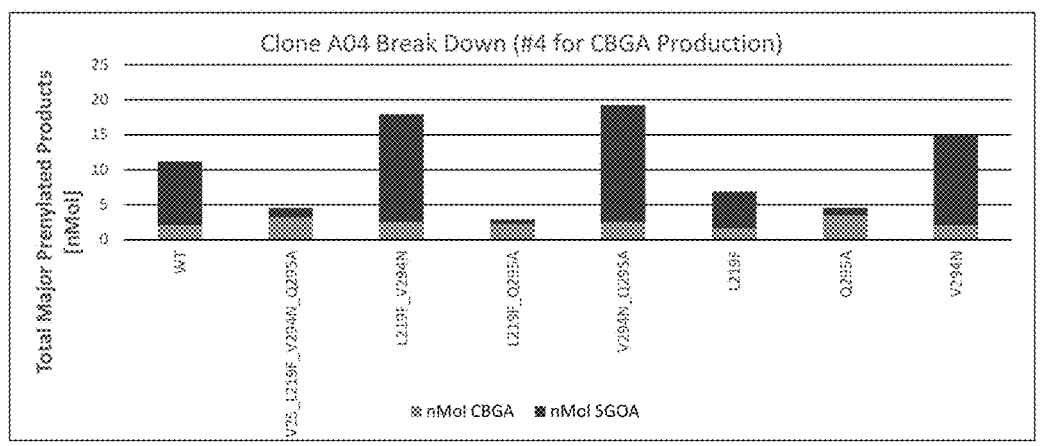
FIG. 8 shows the analysis of ORF2 enzymatic function including total nMols of prenylated products produced (FIG. 8A) and % CBGA produced (FIG. 8B) by mutants derived from the breakdown of ORF2 triple mutant clone A04.
Figure 8B:
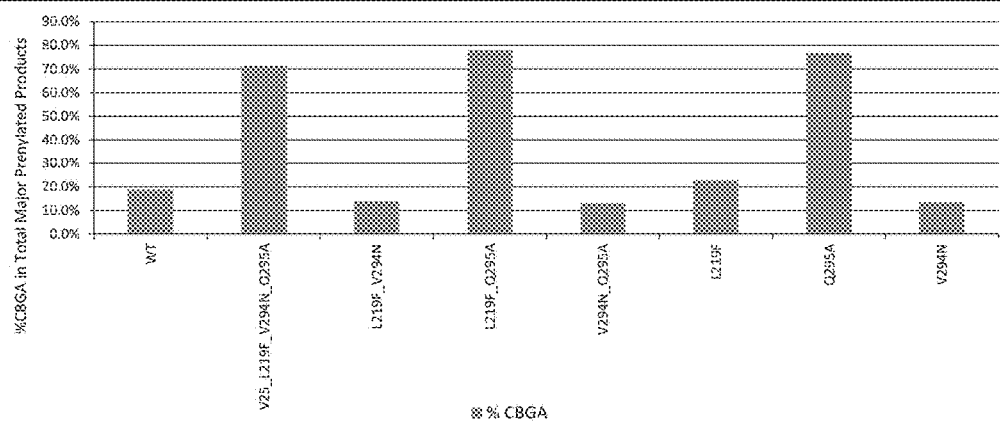
Figure 9A:
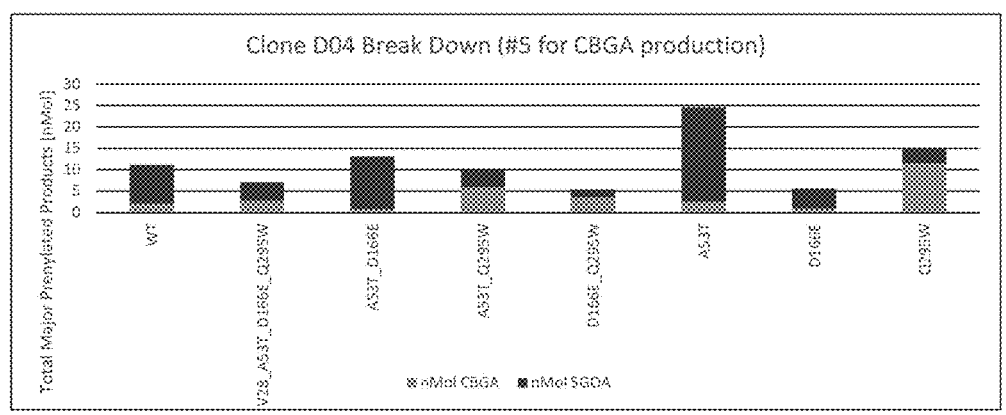
FIG. 9 shows the analysis of ORF2 enzymatic function including total nMols of prenylated products produced (FIG. 9A) and % CBGA produced (FIG. 9B) by mutants derived from the breakdown of ORF2 triple mutant clone D04.
Figure 9B:
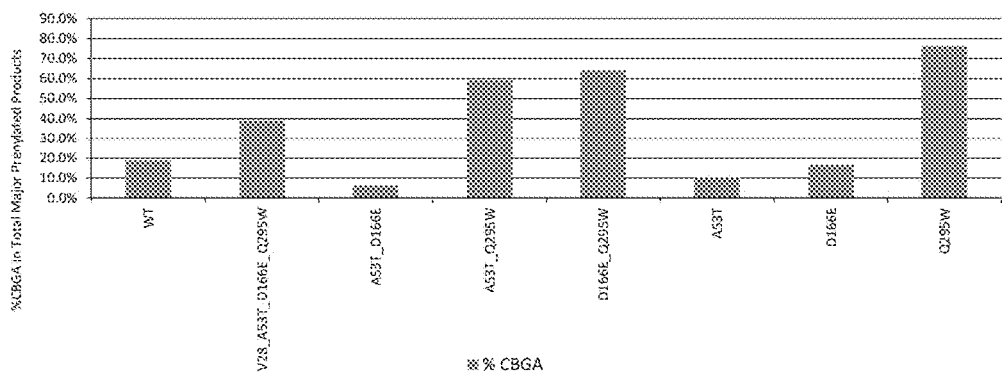
Figure 10A:
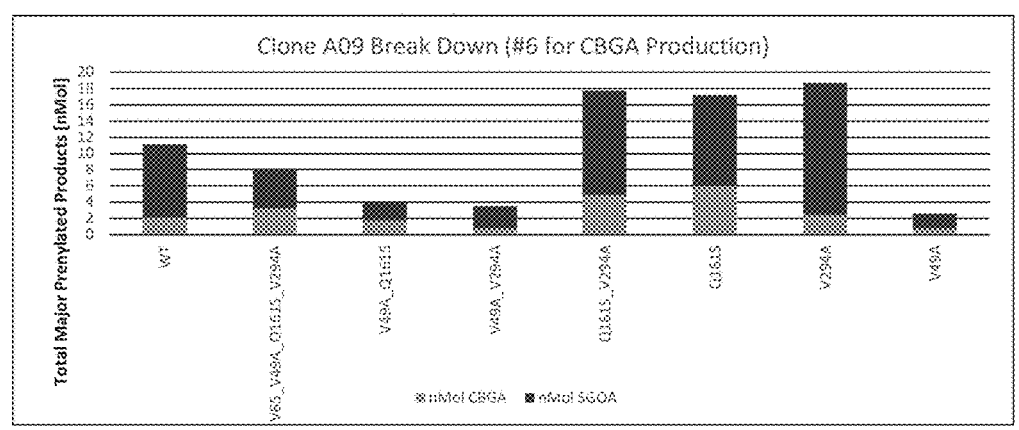
FIG. 10 shows the analysis of ORF2 enzymatic function including total nMols of prenylated products produced (FIG. 10A) and % CBGA produced (FIG. 10B) by mutants derived from the breakdown of ORF2 triple mutant clone A09.
Figure 10B:
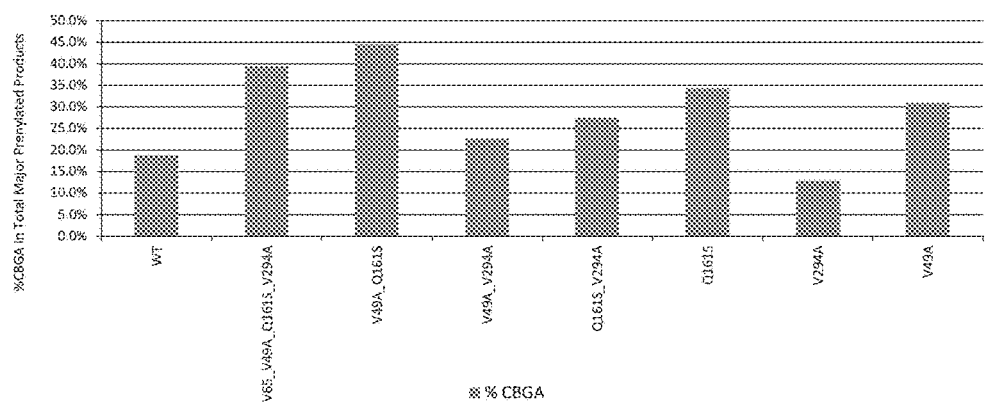
Figure 11A:
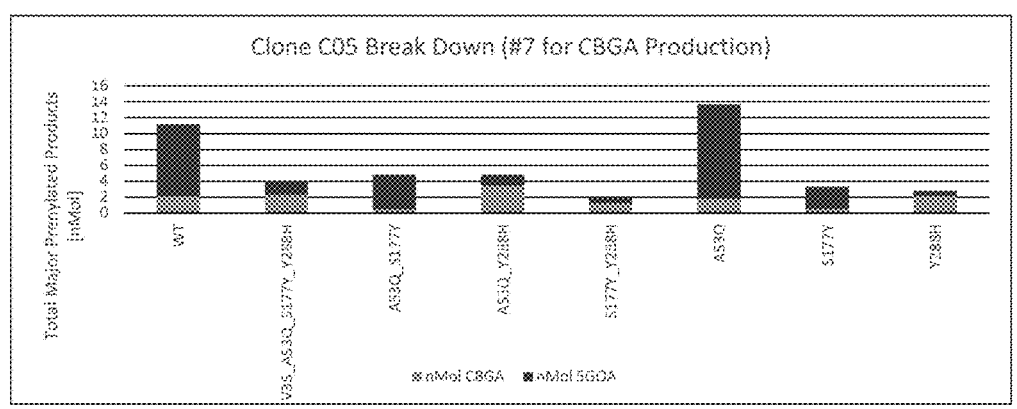
FIG. 11 shows the analysis of ORF2 enzymatic function including total nMols of prenylated products produced (FIG. 11A) and % CBGA produced (FIG. 11B) by mutants derived from the breakdown of ORF2 triple mutant clone C05.
Figure 11B:
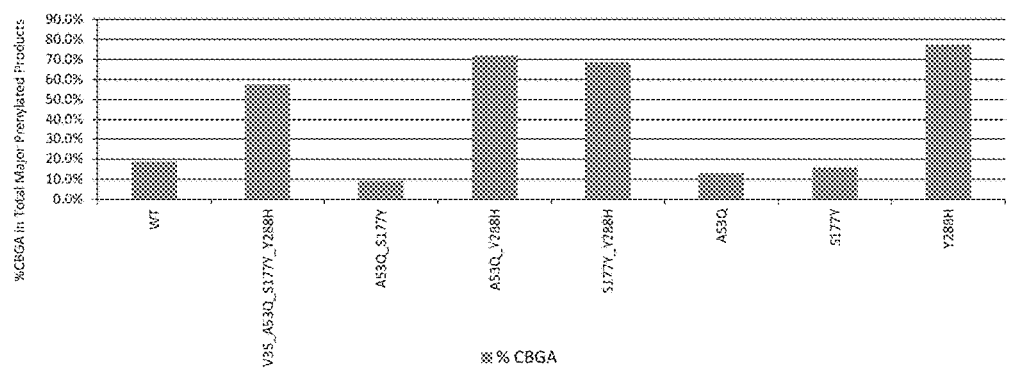
Figure 12A:
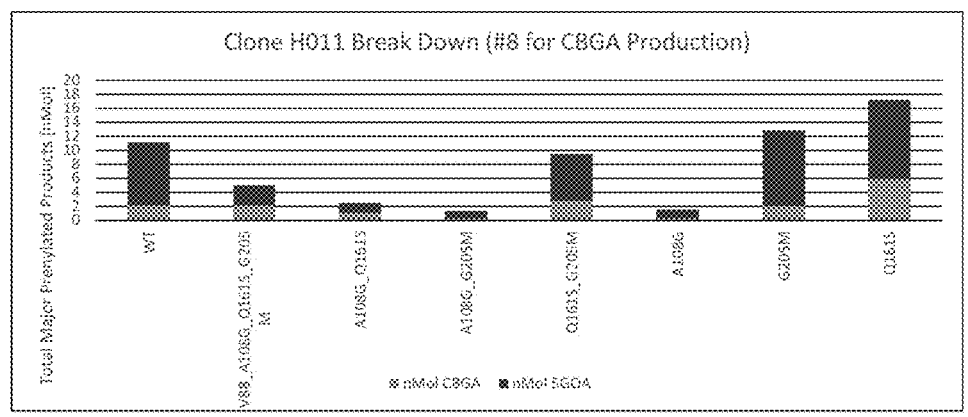
FIG. 12 shows the analysis of ORF2 enzymatic function including total nMols of prenylated products produced (FIG. 12A) and % CBGA produced (FIG. 12B) by mutants derived from the breakdown of ORF2 triple mutant clone H011.
Figure 12B:
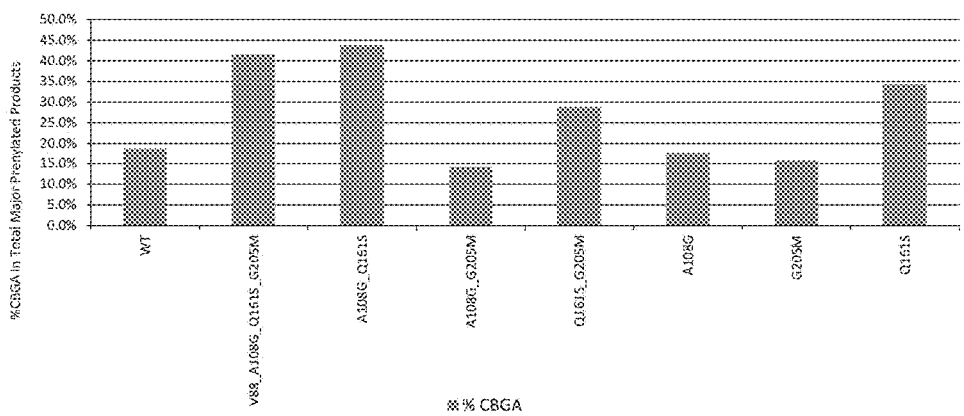
Figure 13A:
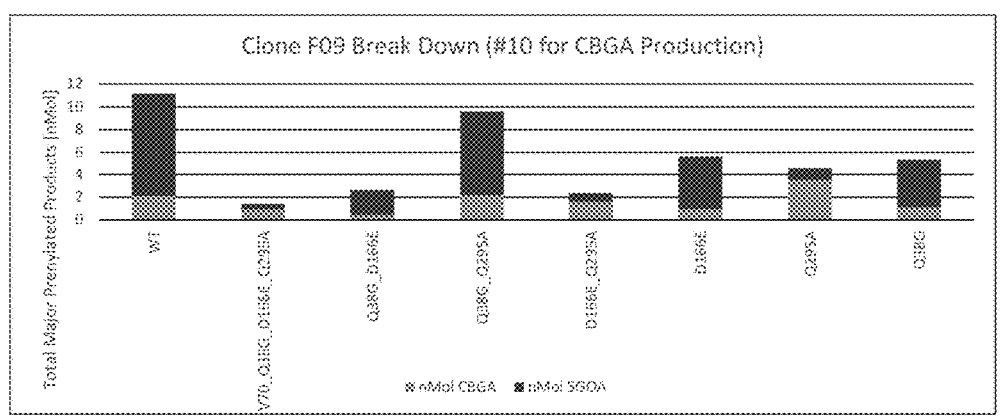
FIG. 13 shows the analysis of ORF2 enzymatic function including total nMols of prenylated products produced (FIG. 13A) and % CBGA produced (FIG. 13B) by mutants derived from the breakdown of ORF2 triple mutant clone F09.
Figure 13B:
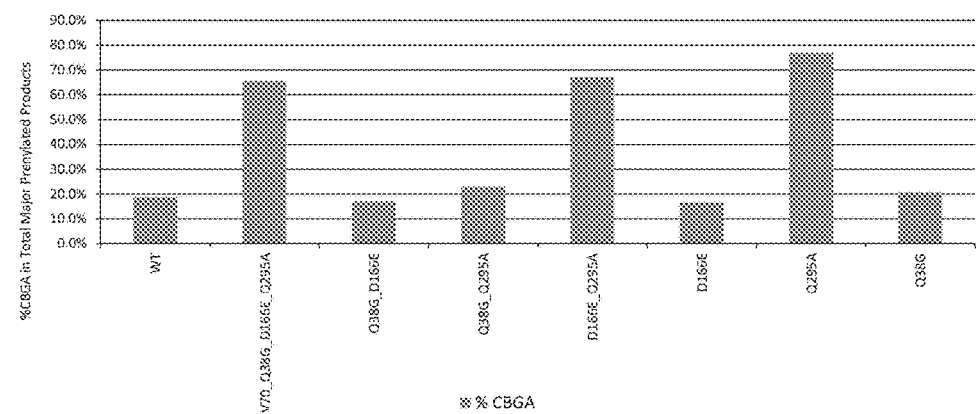
Figure 14A:
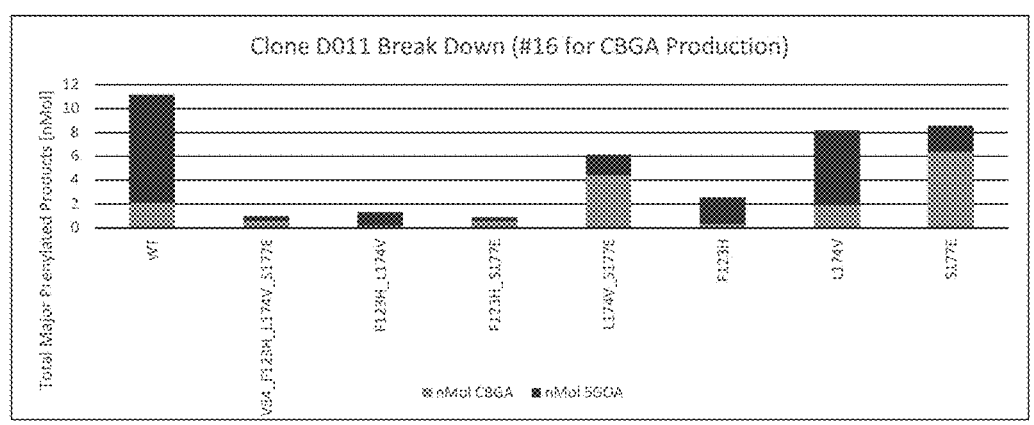
FIG. 14 shows the analysis of ORF2 enzymatic function including total nMols of prenylated products produced (FIG. 14A) and % CBGA produced (FIG. 14B) by mutants derived from the breakdown of ORF2 triple mutant clone D011.
Figure 14B:
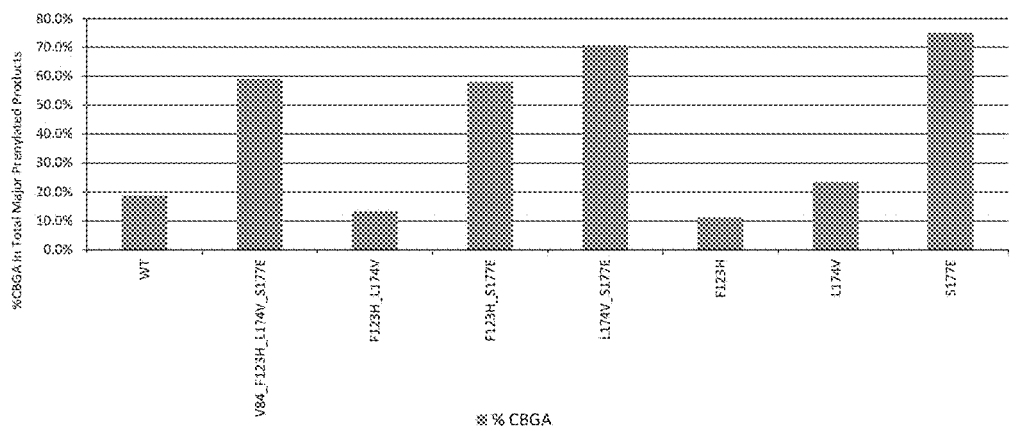
Figure 15A:
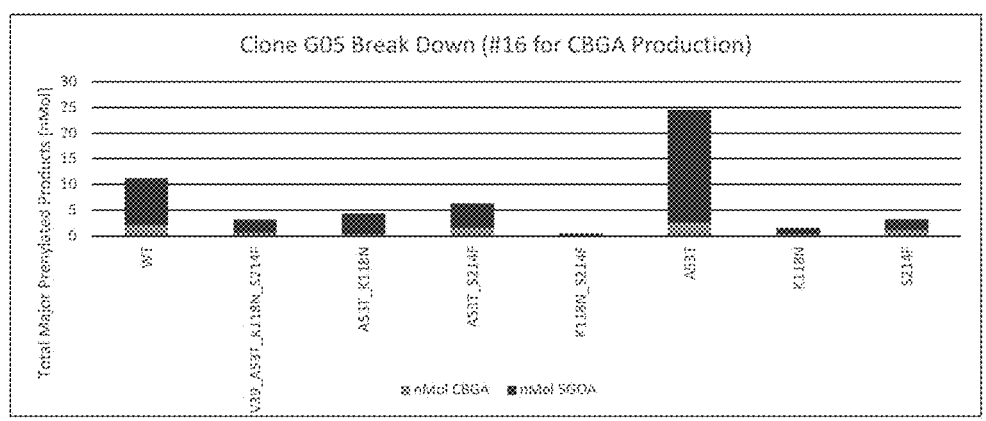
FIG. 15 shows the analysis of ORF2 enzymatic function including total nMols of prenylated products produced (FIG. 15A) and % CBGA produced (FIG. 15B) by mutants derived from the breakdown of ORF2 triple mutant clone G05.
Figure 15B:
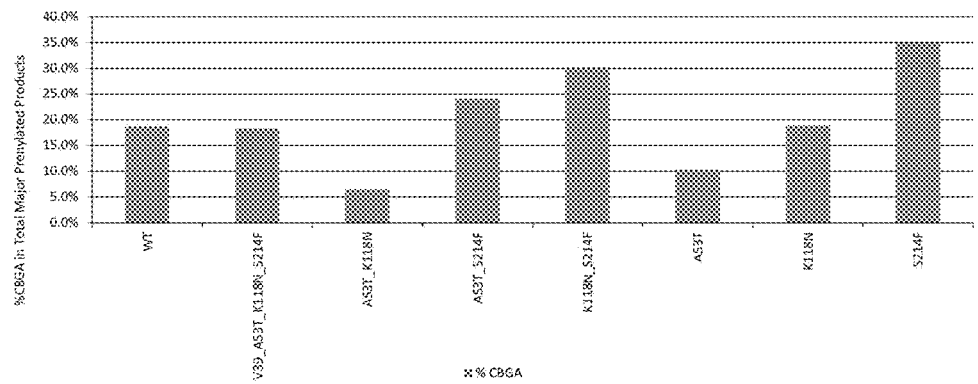
Figure 16A:
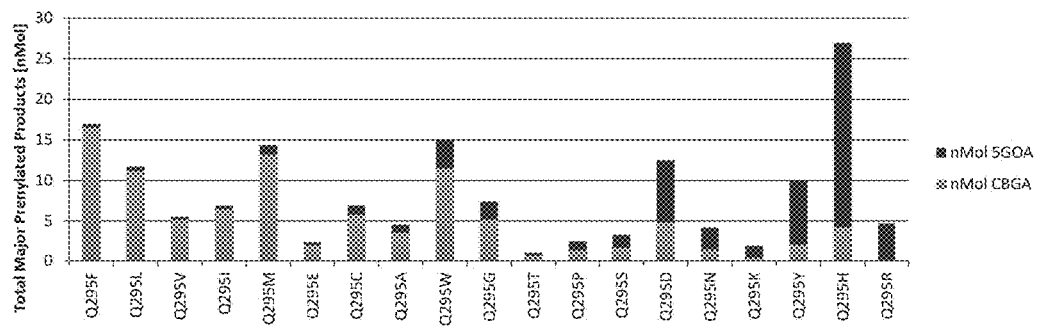
FIG. 16 shows the analysis of enzymatic activity of site-saturated ORF2 mutants of Q295 using OA as substrate and GPP as donor, including total nMols of prenylated products produced (FIG. 16A); CBGA production potential (FIG. 16B); and 5-GOA production potential (FIG. 16C).
Figure 16B:
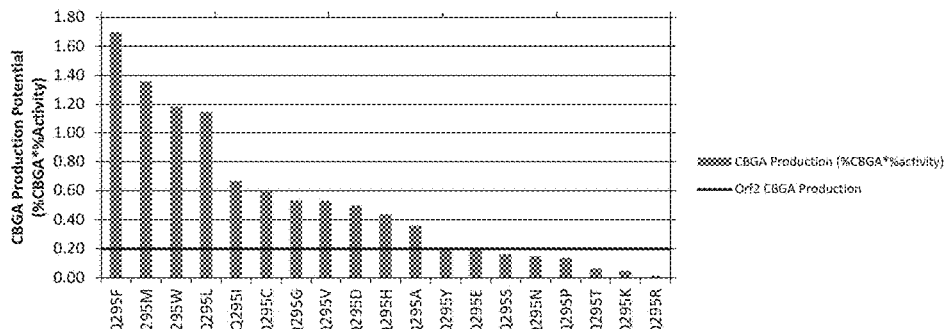
Figure 17A:
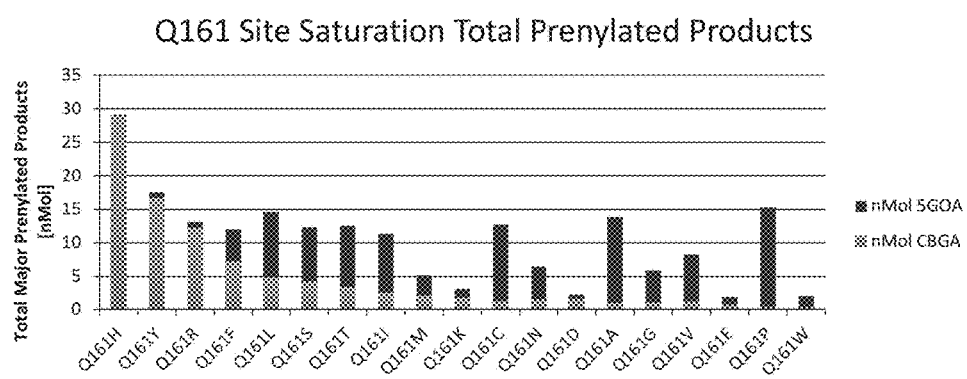
FIG. 17 shows the analysis of enzymatic activity of site-saturated ORF2 mutants of Q161 using OA as substrate and GPP as donor, including total nMols of prenylated products produced (FIG. 17A); CBGA production potential (FIG. 17B); and 5-GOA production potential (FIG. 17C).
Figure 17B:
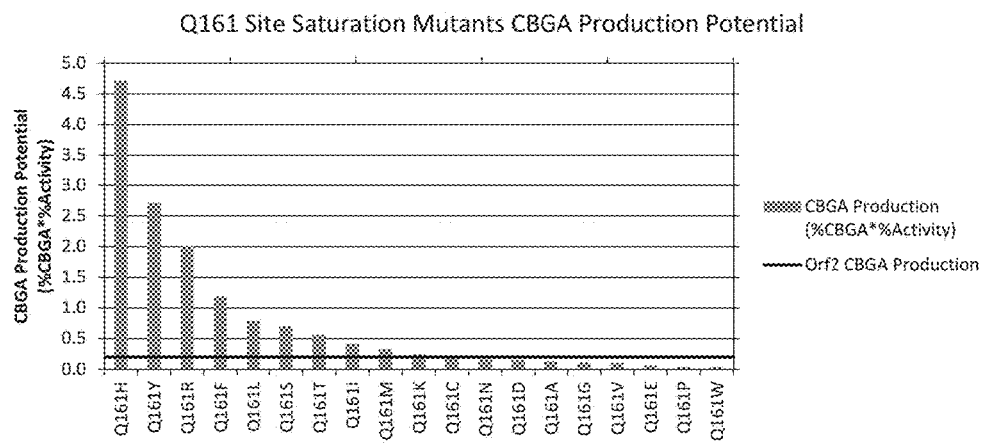
Figure 17C:
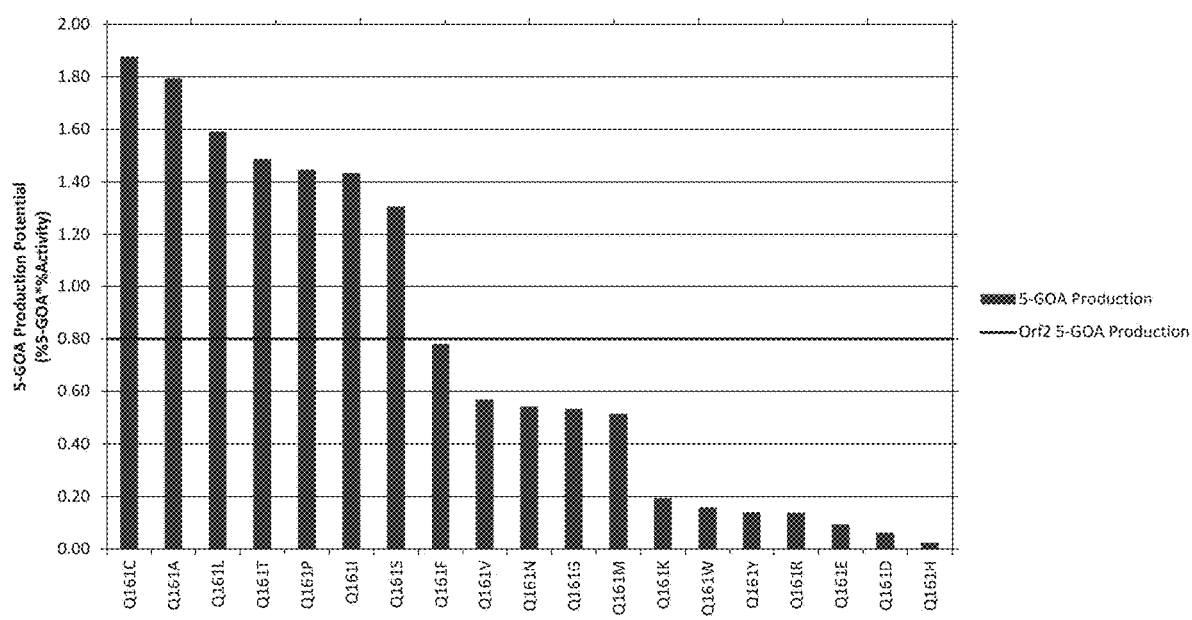
Figure 18A:
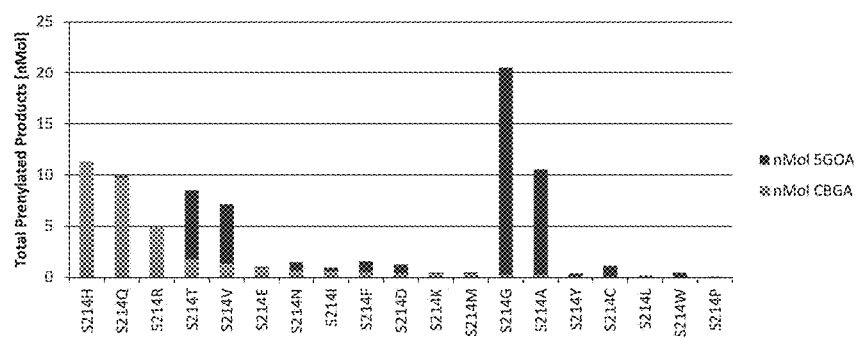
FIG. 18 shows the analysis of enzymatic activity of site-saturated ORF2 mutants of S214 using OA as substrate and GPP as donor, including total nMols of prenylated products produced (FIG. 18A); CBGA production potential (FIG. 18B); and 5-GOA production potential (FIG. 18C).
Figure 18B:
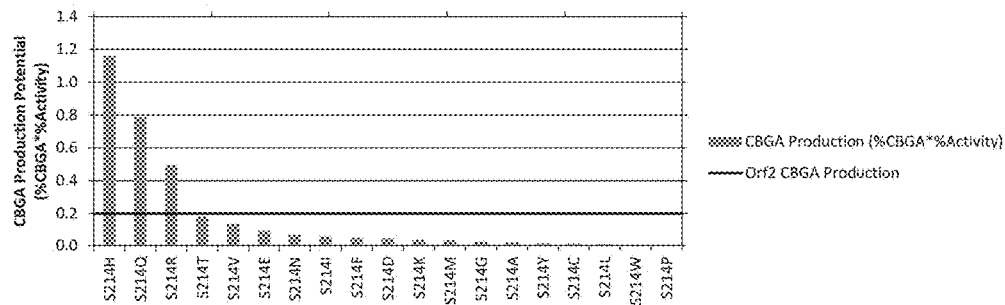
Figure 18C:
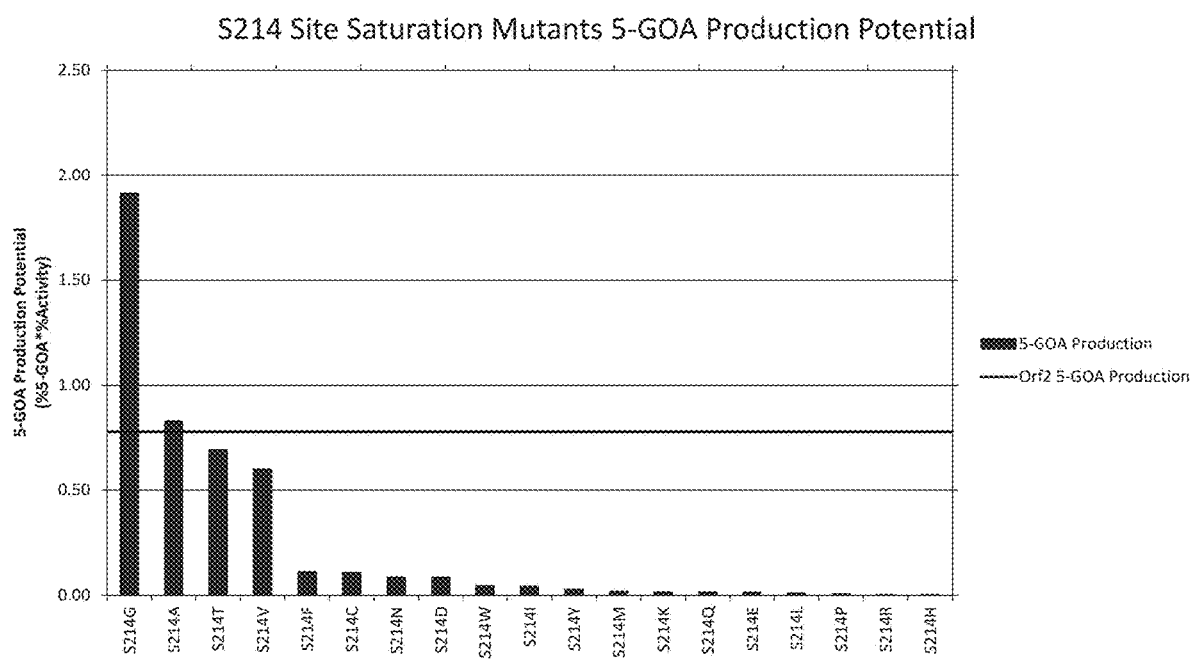

For the singleton and doubleton mutants resulting from the breakdown of triple mutants—E09, H02, A04, D04, A09, C05, H011, F09, D011, and G05—the total amount of prenylated products (and the respective proportion of CBGA and 5-GOA); and % CBGA within the prenylated products was calculated. FIGS. 6-15 depict the total amount of prenylated products and % CBGA produced using OA as substrate and GPP as donor for the mutants derived from E09 (FIG. 6); H02 (FIG. 7); A04 (FIG. 8); D04 (FIG. 9); A09 (FIG. 10); C05 (FIG. 11); H011 (FIG. 12); F09 (FIG. 13); D011 (FIG. 14); and G05 (FIG. 15). The % CBGA; % enzymatic activity; and the CBGA production potential for these clones, along with the mutations they carry, are listed in Table 3.

In a similar manner, the triple mutants, G12, C06 and F08, will also be subjected to "breakdown" analysis. Further, the singleton and double mutants resulting from the breakdown of G12, C06 and F0 will be analyzed to determine the total amount of prenylated products (and the respective proportion of CBGA and 5-GOA); and % CBGA within the prenylated products produced by these mutants, as described above.

TABLE 3

Summary table of enzymatic activity of triple mutants; and the double and single mutants resulting from the breakdown thereof

| | | nMol CBGA | nMol 5GOA | Total Product | % CBGA/5-G (nMol Calculation) | % Activity | CBGA Production (% CBGA * % activity) |
|---|---|---|---|---|---|---|---|
| E9 | A53T_M106E_Q161S | 5.18764814 | 5.01756007 | 10.2052082 | 50.8% | 122.8% | 0.6 |
| 025 | A53T_M106E | 2.25762444 | 8.84592025 | 11.1035447 | 20.3% | 163.7% | 0.3 |
| 026 | A53T_Q161S | 5.06402423 | 20.7614206 | 25.8254449 | 19.6% | 190.3% | 0.37 |
| 027 | M106E_Q161S | 1.97260996 | 1.70913652 | 3.68174647 | 53.6% | 27.1% | 0.15 |
| 033 | A53T | 2.53858309 | 22.0230393 | 24.5616224 | 10.3% | 228.1% | 0.2 |
| 040 | M106E | 1.13455359 | 2.15698442 | 3.29153802 | 34.5% | 30.6% | 0.1 |
| 041 | Q161S | 5.90281801 | 11.3076974 | 17.2105154 | 34.3% | 166.7% | 0.6 |
| H2 | A53Q_S177W_L219F | 3.42156966 | 1.08067072 | 4.50224038 | 76.0% | 52.4% | 0.4 |
| 007.2 | A53Q_S177W | 4.76897551 | 1.45933457 | 6.22831007 | 76.6% | 57.8% | 0.4 |
| 008 | A53Q_L219F | 1.86626284 | 9.95471349 | 11.8209763 | 15.8% | 109.7% | 0.2 |
| 009 | S177W_L219F | 1.5588886 | 0.40797465 | 1.96686325 | 79.3% | 29.0% | 0.2 |
| 032 | A53Q | 1.79288912 | 11.8606417 | 13.6535308 | 13.1% | 126.8% | 0.2 |
| 039.2 | L219F | 1.93410587 | 6.27917877 | 8.21328464 | 23.5% | 76.3% | 0.2 |
| 046 | S177W | 3.56125889 | 0.68108001 | 4.2423389 | 83.9% | 41.1% | 0.3 |
| A4 | L219F_V294N_Q295A | 3.23452726 | 1.29673884 | 4.5312661 | 71.4% | 40.6% | 0.3 |
| 004 | L219F_V294N | 2.50545167 | 15.4131899 | 17.9186415 | 14.0% | 166.3% | 0.2 |
| 005.1 | L219F_Q295A | 2.25069792 | 0.63585952 | 2.88655744 | 78.0% | 26.8% | 0.2 |
| 006 | V294N_Q295A | 2.49960495 | 16.7207552 | 19.2203602 | 13.0% | 178.4% | 0.2 |
| 039.1 | L219F | 1.56952858 | 5.33575389 | 6.90528247 | 22.7% | 64.1% | 0.1 |
| 042 | Q295A | 3.49144061 | 1.05584896 | 4.54728957 | 76.8% | 44.0% | 0.3 |
| 050 | V294N | 2.00010535 | 12.8829548 | 14.8830602 | 13.4% | 144.2% | 0.2 |
| D4 | A53T_D166E_Q295W | 2.74848565 | 4.29812517 | 7.04661081 | 39.0% | 74.2% | 0.3 |
| 016 | A53T_D166E | 0.82704767 | 12.2768022 | 13.1038499 | 6.3% | 193.2% | 0.1 |
| 017 | A53T_Q295W | 5.82552015 | 4.01524954 | 9.84076969 | 59.2% | 145.1% | 0.9 |
| 018 | D166E_Q295W | 3.43766131 | 1.92018748 | 5.3578488 | 64.2% | 79.0% | 0.5 |
| 033 | A53T | 2.53858309 | 22.0230393 | 24.5616224 | 10.3% | 228.1% | 0.2 |
| 034 | D166E | 0.93471161 | 4.71177713 | 5.64648875 | 16.6% | 52.4% | 0.1 |
| 043 | Q295W | 11.4932578 | 3.57948244 | 15.0727403 | 76.3% | 146.0% | 1.1 |
| A9 | V49A_Q161S_V294A | 3.19657624 | 4.90757856 | 8.1041548 | 39.4% | 72.7% | 0.3 |
| 022 | V49A_Q161S | 1.74851198 | 2.17764721 | 3.9261592 | 44.5% | 57.9% | 0.3 |
| 023 | V49A_V294A | 0.78309191 | 2.6874835 | 3.47057541 | 22.6% | 51.2% | 0.1 |
| 024 | Q161S_V294A | 4.87521728 | 12.8399129 | 17.7151301 | 27.5% | 261.2% | 0.7 |
| 041 | Q161S | 5.90281801 | 11.3076974 | 17.2105154 | 34.3% | 166.7% | 0.6 |
| 049 | V294A | 2.4024493 | 16.2872987 | 18.689748 | 12.9% | 181.0% | 0.2 |
| 051 | V49A | 0.78854359 | 1.76458938 | 2.55313297 | 30.9% | 24.7% | 0.1 |
| C5 | A53Q_S177Y_Y288H | 2.32983935 | 1.71626617 | 4.04610552 | 57.6% | 42.6% | 0.2 |
| 019 | A53Q_S177Y | 0.44303397 | 4.4004489 | 4.84348288 | 9.1% | 71.4% | 0.1 |
| 020 | A53Q_Y288H | 3.49228338 | 1.37476895 | 4.86705233 | 71.8% | 71.8% | 0.5 |
| 021 | S177Y_Y288H | 1.27124045 | 0.5814629 | 1.85270335 | 68.6% | 27.3% | 0.2 |
| 032 | A53Q | 1.79288912 | 11.8606417 | 13.6535308 | 13.1% | 126.8% | 0.2 |
| 047 | S177Y | 0.52881222 | 2.78901505 | 3.31782727 | 15.9% | 32.1% | 0.1 |
| 052 | Y288H | 2.15583355 | 0.63321891 | 2.78905246 | 77.3% | 27.0% | 0.2 |
| H11 | A108G_Q161S_G205M | 2.06831709 | 2.91536837 | 4.98368546 | 41.5% | 58.0% | 0.2 |
| 010 | A108G_Q161S | 1.07729787 | 1.38302086 | 2.46031873 | 43.8% | 36.3% | 0.2 |
| 011 | A108G_G205M | 0.189202 | 1.1392263 | 1.3284283 | 14.2% | 19.6% | 0.0 |
| 012 | Q161S_G205M | 2.73157756 | 6.75105625 | 9.48263381 | 28.8% | 139.8% | 0.4 |
| 031 | A108G | 0.26987095 | 1.27515184 | 1.54502279 | 17.5% | 14.4% | 0.0 |
| 036 | G205M | 2.02009481 | 10.8182598 | 12.8383546 | 15.7% | 119.2% | 0.2 |
| 041 | Q161S | 5.90281801 | 11.3076974 | 17.2105154 | 34.3% | 166.7% | 0.6 |
| F9 | Q38G_D166E_Q295A | 0.91588096 | 0.48336418 | 1.3992451 | 65.5% | 16.8% | 0.1 |
| 001 | Q38G_D166E | 0.44666842 | 2.19118035 | 2.63784878 | 16.9% | 24.5% | 0.0 |
| 002 | Q38G_Q295A | 2.20134317 | 7.38011619 | 9.58145935 | 23.0% | 88.9% | 0.2 |
| 003 | D166E_Q295A | 1.57469055 | 0.7702667 | 2.34495725 | 67.2% | 21.8% | 0.1 |
| 034 | D166E | 0.93471161 | 4.71177713 | 5.64648875 | 16.6% | 52.4% | 0.1 |
| 042 | Q295A | 3.49144061 | 1.05584896 | 4.54728957 | 76.8% | 44.0% | 0.3 |
| 044 | Q38G | 1.09681327 | 4.18807763 | 5.28489091 | 20.8% | 51.2% | 0.1 |
| D11 | F123H_L174V_S177E | 0.57303134 | 0.39787431 | 0.97090565 | 59.0% | 11.7% | 0.1 |
| 013 | F123H_L174V | 0.1767448 | 1.15110906 | 1.32785386 | 13.3% | 19.6% | 0.0 |
| 014 | F123H_S177E | 0.51964709 | 0.37740676 | 0.89705665 | 57.9% | 13.2% | 0.1 |
| 015 | L174V_S177E | 4.34427179 | 1.80921574 | 6.15348753 | 70.6% | 90.7% | 0.6 |
| 035 | F123H | 0.28346063 | 2.26571165 | 2.54917227 | 11.1% | 23.7% | 0.0 |
| 038 | L174V | 1.91411641 | 6.27865065 | 8.19276705 | 23.4% | 80.0% | 0.2 |
| 045 | S177E | 6.41430076 | 2.15579614 | 8.57009691 | 74.8% | 83.0% | 0.6 |
| G5 | A53T_K118N_S214F | 0.58190677 | 2.59559018 | 3.17749695 | 18.3% | 36.9% | 0.1 |
| 028 | A53T_K118N | 0.2830129 | 4.06093214 | 4.34394504 | 6.5% | 64.1% | 0.0 |
| 029.2 | A53T_S214F | 1.51042929 | 4.76392923 | 6.27435852 | 24.1% | 92.5% | 0.2 |
| 030 | K118N_S214F | 0.14572031 | 0.33747902 | 0.4831906 | 30.2% | 7.1% | 0.0 |
| 033 | A53T | 2.53858309 | 22.0230393 | 24.5616224 | 10.3% | 228.1% | 0.2 |
| 037 | K118N | 0.28854359 | 1.24042778 | 1.52897137 | 18.9% | 14.2% | 0.0 |
| 048 | S214F | 1.11524888 | 2.08588593 | 3.20113481 | 34.8% | 31.0% | 0.1 |
| G12 | A17T_Q161W_A232S | 6.10990255 | 0.61493266 | 6.72483522 | 90.86% | 78.20% | 0.7 |
| q423-1 | A17T | 1.06431393 | 5.17593082 | 6.24024475 | 17.06% | 50.31% | 0.1 |

TABLE 3-continued

Summary table of enzymatic activity of triple mutants; and the double and single mutants resulting from the breakdown thereof

| | | nMol CBGA | nMol 5GOA | Total Product | % CBGA/5-G (nMol Calculation) | % Activity | CBGA Production (% CBGA * % activity) |
|---|---|---|---|---|---|---|---|
| EE09 | Q161W | 0.37682381 | 1.63856615 | 2.01538996 | 18.70% | 19.52% | 0.0 |
| 424-1 | A232S | 8.72878588 | 1.57004225 | 10.2988281 | 84.76% | 83.03% | 0.7 |
| C06 | Q161A_M162F_Q295A | 0.92602054 | 0.85298389 | 1.77900443 | 52.05% | 18.72% | 0.10 |
| DD01 | Q161A | 0.94174348 | 12.9347769 | 13.8765203 | 6.79% | 192.32% | 0.13 |
| 431-1 | M162F | 0.94661575 | 0.40150515 | 1.3481209 | 70.22% | 10.87% | 0.08 |
| 042 | Q295A | 3.49144061 | 1.05584896 | 4.54728957 | 76.78% | 46.74% | 0.36 |
| F08 | A53T_N173D_S214R | 0.69665525 | 0.01960655 | 0.7162618 | 97.26% | 8.62% | 0.08 |
| 033 | A53T | 2.53858309 | 22.0230393 | 24.5616224 | 10.34% | 220.33% | 0.23 |
| 427-4 | N173D | 0.07008164 | 0.44725376 | 0.51733541 | 13.55% | 4.17% | 0.01 |
| BB05 | S214R | 4.81951541 | 0.02554793 | 4.84506333 | 99.47% | 49.81% | 0.50 |

This analysis provided important insights into which positions on ORF2, when mutated, are likely to give rise to significant effects on the enzymatic activity of ORF2 in the reaction using Olivetolic Acid (OA) as substrate and Geranyl pyrophosphate (GPP) as donor. Based on this analysis, the following amino acid sites were selected for targeted amino acid site saturation mutagenesis—M106, Q161, S177, Q295, Y288, S214, M162 and A232.

Site saturated mutagenesis was done for Q295, Q161, S214 and Y288 by replacing the wild type residue with each of the other 19 standard amino acids. The amount of total prenylated products, the CBGA production potential and GOA production potential was measured for each of the site saturated mutants. These results are depicted in FIGS. 16, 17, 18 and 97; and Tables 4, 5, 6 and 7.

TABLE 4

Q295 site saturated mutants

| Mutations | nMol CBGA | nMol 5GOA | Total Product | % CBGA/5-G (nMol Calculation) | % Activity | CBGA Production potential (% CBGA * % activity) | %5-GOA | 5-GOA Production Potential |
|---|---|---|---|---|---|---|---|---|
| Q295H | 4.22220174 | 22.7255743 | 26.9477761 | 15.7% | 277.0% | 0.43 | 84.33% | 2.34 |
| Q295Y | 2.00331841 | 8.06476102 | 10.0680794 | 19.9% | 103.5% | 0.21 | 80.10% | 0.83 |
| Q295D | 4.84511456 | 7.65619224 | 12.5013068 | 38.8% | 128.5% | 0.50 | 61.24% | 0.79 |
| Q295R | 0.10247564 | 4.60489834 | 4.70737398 | 2.2% | 48.4% | 0.01 | 97.82% | 0.47 |
| Q295W | 11.4932578 | 3.57948244 | 15.0727403 | 76.3% | 154.9% | 1.18 | 23.75% | 0.37 |
| Q295N | 1.44316566 | 2.64978875 | 4.09295441 | 35.3% | 42.1% | 0.15 | 64.74% | 0.27 |
| Q295G | 5.17814064 | 2.21283338 | 7.39097401 | 70.1% | 76.0% | 0.53 | 29.94% | 0.23 |
| Q295S | 1.59531209 | 1.62780565 | 3.22311774 | 49.5% | 33.1% | 0.16 | 50.50% | 0.17 |
| Q295K | 0.44076903 | 1.42738315 | 1.86815218 | 23.6% | 19.2% | 0.05 | 76.41% | 0.15 |
| Q295C | 5.74598367 | 1.17837338 | 6.92435705 | 83.0% | 71.2% | 0.59 | 17.02% | 0.12 |
| Q295M | 13.1925467 | 1.1651043 | 14.3576511 | 91.9% | 147.6% | 1.36 | 8.11% | 0.12 |
| Q295P | 1.31361601 | 1.10628466 | 2.41990067 | 54.3% | 24.9% | 0.14 | 45.72% | 0.11 |
| Q295A | 3.49144061 | 1.05584896 | 4.54728957 | 76.8% | 46.7% | 0.36 | 23.22% | 0.11 |
| Q295L | 11.1453516 | 0.5400713 | 11.6854229 | 95.4% | 120.1% | 1.15 | 4.62% | 0.06 |
| Q295I | 6.45699236 | 0.44982836 | 6.90682072 | 93.5% | 71.0% | 0.66 | 6.51% | 0.05 |
| Q295F | 16.5020543 | 0.44533932 | 16.9473936 | 97.4% | 174.2% | 1.70 | 2.63% | 0.05 |
| Q295E | 1.93961022 | 0.39358331 | 2.33319353 | 83.1% | 24.0% | 0.20 | 16.87% | 0.04 |
| Q295T | 0.605399 | 0.37734354 | 0.98274254 | 61.6% | 10.1% | 0.06 | 38.40% | 0.04 |
| Q295V | 5.16273374 | 0.35549247 | 5.51822621 | 93.6% | 56.7% | 0.53 | 6.44% | 0.04 |

TABLE 5

Q161 site saturated mutants

| Mutations | nMol CBGA | nMol 5GOA | Total Product | % CBGA | % Activity | CBGA Production potential (% CBGA * % Activity) | %5-GOA | 5-GOA Production potential |
|---|---|---|---|---|---|---|---|---|
| Q161C | 1.254227021 | 11.51921 | 12.77343748 | 9.82% | 208.10% | 0.2 | 90.18% | 1.88 |
| Q161A | 0.941743482 | 12.934777 | 13.87652035 | 6.79% | 192.32% | 0.1 | 93.21% | 1.79 |
| Q161L | 4.847326837 | 9.7688144 | 14.6161412 | 33.16% | 238.12% | 0.8 | 66.84% | 1.59 |
| Q161T | 3.438504082 | 9.1266174 | 12.56512146 | 27.37% | 204.71% | 0.6 | 72.63% | 1.49 |
| Q161P | 0.405504346 | 14.929496 | 15.33499999 | 2.64% | 148.54% | 0.0 | 97.36% | 1.45 |
| Q161I | 2.557940479 | 8.7985213 | 11.35646174 | 22.52% | 185.01% | 0.4 | 77.48% | 1.43 |

TABLE 5-continued

Q161 site saturated mutants

| Mutations | nMol CBGA | nMol 5GOA | Total Product | % CBGA | % Activity | CBGA Production potential (% CBGA * % Activity) | %5-GOA | 5-GOA Production potential |
|---|---|---|---|---|---|---|---|---|
| Q161S | 4.329707664 | 8.0136652 | 12.34337283 | 35.08% | 201.09% | 0.7 | 64.92% | 1.31 |
| Q161F | 7.260284435 | 4.7907314 | 12.05101588 | 60.25% | 196.33% | 1.2 | 39.75% | 0.78 |
| Q161V | 1.213141954 | 7.0618564 | 8.274998305 | 14.66% | 0.667157399 | 0.1 | 85.34% | 0.57 |
| Q161N | 1.500052673 | 4.9663322 | 6.466384862 | 23.20% | 70.58% | 0.2 | 76.80% | 0.54 |
| Q161G | 1.023755597 | 4.8859916 | 5.909747147 | 17.32% | 64.50% | 0.1 | 82.68% | 0.53 |
| Q161M | 2.039636555 | 3.1520993 | 5.191735842 | 39.29% | 84.58% | 0.3 | 60.71% | 0.51 |
| Q161K | 1.740242297 | 1.3897544 | 3.12999672 | 55.60% | 43.38% | 0.2 | 44.40% | 0.19 |
| Q161W | 0.376823808 | 1.6385661 | 2.015389956 | 18.70% | 19.52% | 0.0 | 81.30% | 0.16 |
| Q161Y | 16.66784303 | 0.853644 | 17.52148708 | 95.13% | 285.45% | 2.7 | 4.87% | 0.14 |
| Q161R | 12.29307348 | 0.8494851 | 13.14255856 | 93.54% | 214.11% | 2.0 | 6.46% | 0.14 |
| Q161E | 0.711877798 | 1.1597571 | 1.871634862 | 38.04% | 0.150897318 | 0.1 | 61.96% | 0.09 |
| Q161D | 1.577482223 | 0.6375099 | 2.214992125 | 71.22% | 21.46% | 0.2 | 28.78% | 0.06 |
| Q161H | 28.94774822 | 0.1498548 | 29.09760299 | 99.48% | 474.04% | 4.7 | 0.52% | 0.02 |

TABLE 6

S214 site saturated mutants

| Mutations | nMol CBGA | nMol 5GOA | Total Product | % CBGA | % Activity | CBGA Production potential (% CBGA * % Activity) | %5-GOA | 5-GOA Production potential |
|---|---|---|---|---|---|---|---|---|
| S214G | 0.24445615 | 20.3160153 | 20.5604715 | 1.19% | 1.93572414 | 0.0 | 98.81% | 1.91 |
| S214A | 0.25283118 | 10.2950885 | 10.5479196 | 2.40% | 0.85040774 | 0.0 | 97.60% | 0.83 |
| S214T | 1.76771135 | 6.74755743 | 8.51526878 | 0.20759314 | 87.5% | 0.2 | 79.24% | 0.69 |
| S214V | 1.32546747 | 5.81905202 | 7.14451949 | 0.18552227 | 73.4% | 0.1 | 81.45% | 0.60 |
| S214F | 0.49836713 | 1.06515712 | 1.56352425 | 0.31874602 | 16.1% | 0.1 | 68.13% | 0.11 |
| S214C | 0.10466157 | 1.04436229 | 1.14902387 | 0.09108738 | 11.8% | 0.0 | 90.89% | 0.11 |
| S214N | 0.68001053 | 0.82479535 | 1.50480589 | 0.45189253 | 15.5% | 0.1 | 54.81% | 0.08 |
| S214D | 0.45604425 | 0.81383681 | 1.26988106 | 0.35912359 | 13.1% | 0.0 | 64.09% | 0.08 |
| S214W | 0.04042665 | 0.43999208 | 0.48041873 | 0.08414879 | 4.9% | 0.0 | 91.59% | 0.05 |
| S214I | 0.56523571 | 0.41107737 | 0.97631308 | 0.57894924 | 10.0% | 0.1 | 42.11% | 0.04 |
| S214Y | 0.13197261 | 0.2728413 | 0.40481391 | 0.32600809 | 4.2% | 0.0 | 67.40% | 0.03 |
| S214M | 0.32538846 | 0.17685503 | 0.50224349 | 0.64786994 | 5.2% | 0.0 | 35.21% | 0.02 |
| S214K | 0.3499605 | 0.14536572 | 0.49532622 | 0.70652528 | 5.1% | 0.0 | 29.35% | 0.01 |
| S214Q | 9.75167237 | 0.17533668 | 9.92700905 | 98.23% | 0.8003479 | 0.8 | 1.77% | 0.01 |
| S214E | 0.92546747 | 0.1245709 | 1.05003837 | 0.88136538 | 10.8% | 0.1 | 11.86% | 0.01 |
| S214L | 0.09649723 | 0.09704251 | 0.19353975 | 0.4985913 | 2.0% | 0.0 | 50.14% | 0.01 |
| S214P | 0.00397682 | 0.07123053 | 0.07520735 | 5.29% | 0.00734429 | 0.0 | 94.71% | 0.01 |
| S214R | 4.81951541 | 0.02554793 | 4.84506333 | 0.99472702 | 49.8% | 0.5 | 0.53% | 0.00 |
| S214H | 11.2844614 | 0.02310536 | 11.3075668 | 0.99795665 | 116.2% | 1.2 | 0.20% | 0.00 |

TABLE 7

Y288 site saturated mutants

| Mutations | nMol CBGA | nMol 5-GOA | Total Product | % Activity | % CBGA | CBGA Production potential (% CBGA * % Activity) | %5-GOA | 5-GOA Production potential |
|---|---|---|---|---|---|---|---|---|
| Y288A | 18.58056 | 0.080539 | 18.6611 | 150.45% | 99.57% | 1.50 | 0.43% | 0.65% |
| Y288C | 15.67369 | 0.122326 | 15.79602 | 127.35% | 99.23% | 1.26 | 0.77% | 0.99% |
| Y288D | 0.84335 | 0.022907 | 0.866257 | 6.98% | 97.36% | 0.07 | 2.64% | 0.18% |
| Y288E | 0.689123 | 0.020267 | 0.70939 | 5.72% | 97.14% | 0.06 | 2.86% | 0.16% |
| Y288F | 17.65373 | 0.056641 | 17.71037 | 142.79% | 99.68% | 1.42 | 0.32% | 0.46% |
| Y288G | 3.125836 | 0.044626 | 3.170463 | 25.56% | 98.59% | 0.25 | 1.41% | 0.36% |
| Y288H | 1.618251 | 0.489636 | 2.107887 | 16.99% | 76.77% | 0.13 | 23.23% | 3.95% |
| Y288I | 18.85518 | 0.210655 | 19.06583 | 153.71% | 98.90% | 1.52 | 1.10% | 1.70% |
| Y288K | 0.169213 | 0.019144 | 0.188357 | 1.52% | 89.84% | 0.01 | 10.16% | 0.15% |
| Y288L | 22.29837 | 0.154872 | 22.45324 | 181.03% | 99.31% | 1.80 | 0.69% | 1.25% |
| Y288M | 14.31317 | 0.177779 | 14.49095 | 116.83% | 98.77% | 1.15 | 1.23% | 1.43% |
| Y288P | 20.40645 | 0.068656 | 20.47511 | 165.08% | 99.66% | 1.65 | 0.34% | 0.55% |
| Y288R | 0.299368 | 0.050568 | 0.349936 | 2.82% | 85.55% | 0.02 | 14.45% | 0.41% |

TABLE 7-continued

Y288 site saturated mutants

| Mutations | nMol CBGA | nMol 5-GOA | Total Product | % Activity | % CBGA | CBGA Production potential (% CBGA * % Activity) | %5-GOA | 5-GOA Production potential |
|---|---|---|---|---|---|---|---|---|
| Y288S | 3.383408 | 0.064497 | 3.447905 | 27.80% | 98.13% | 0.27 | 1.87% | 0.52% |
| Y288T | 14.22997 | 0.21356 | 14.44353 | 116.45% | 98.52% | 1.15 | 1.48% | 1.72% |
| Y288W | 4.307032 | 0.107671 | 4.414703 | 35.59% | 97.56% | 0.35 | 2.44% | 0.87% |
| Y288N | 1.164077 | 0.105625 | 1.269701 | 10.24% | 91.68% | 0.09 | 8.32% | 0.85% |

Similarly, site saturated mutagenesis will also be completed for M106, and S177; and the amount of total prenylated products and the CBGA production potential will be measured for each of these site saturated mutants.

From the results described above, multiple mutations of Q295, Q16I, Y288 and S214 that have significantly higher CBGA production potential and/or the total amount of prenylated products, as compared to WT ORF2, were identified. Thus, the ORF2 mutants disclosed herein have unexpectedly superior enzymatic functions, in a reaction using OA as a substrate and GPP as donor, as compared to WT ORF2.

Figure 19:
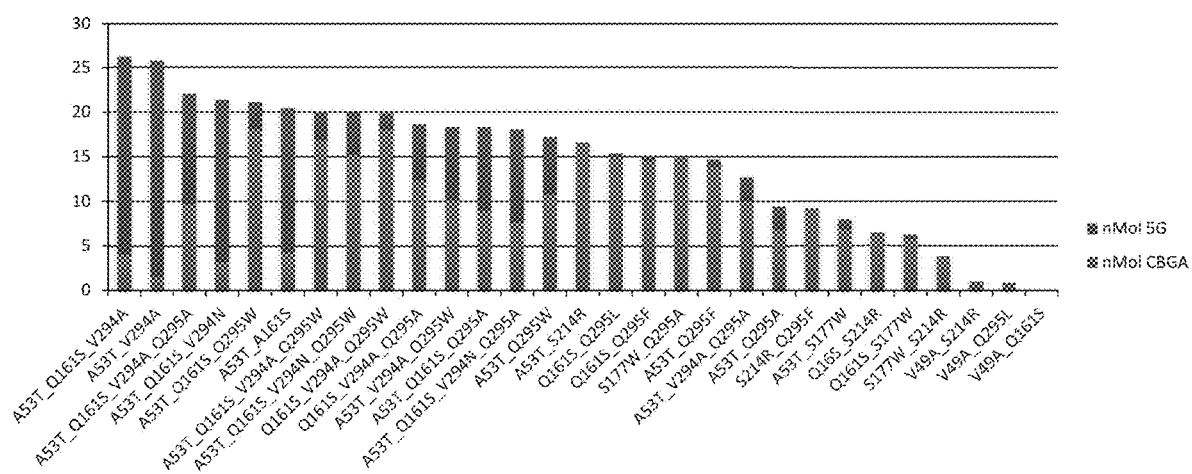
FIG. 19 shows the total nMol of prenylated products produced (using OA as substrate and GPP as donor) by ORF2 stacking mutants.
Figure 20:
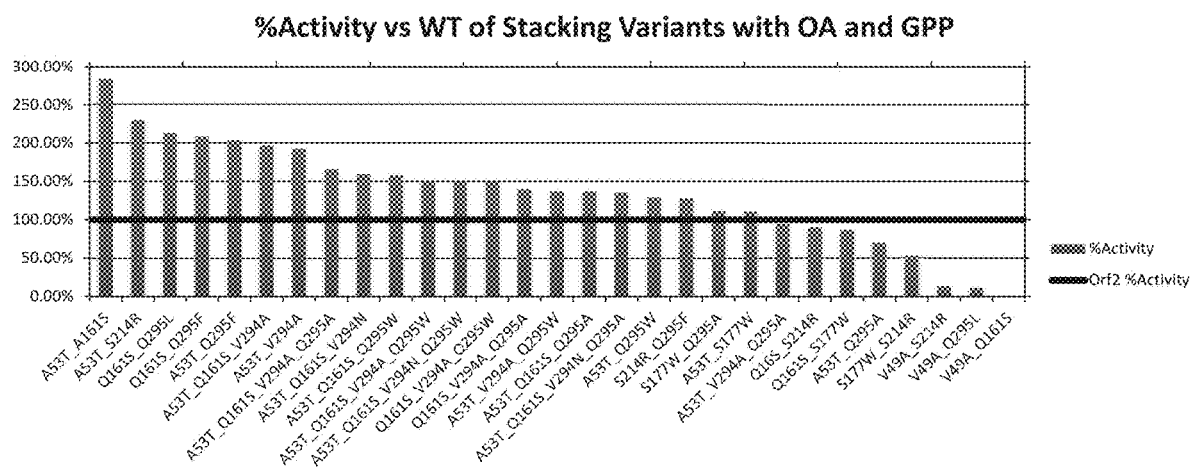
FIG. 20 shows the % enzymatic activity (using OA as substrate and GPP as donor) of ORF2 stacking mutants.
Figure 21:
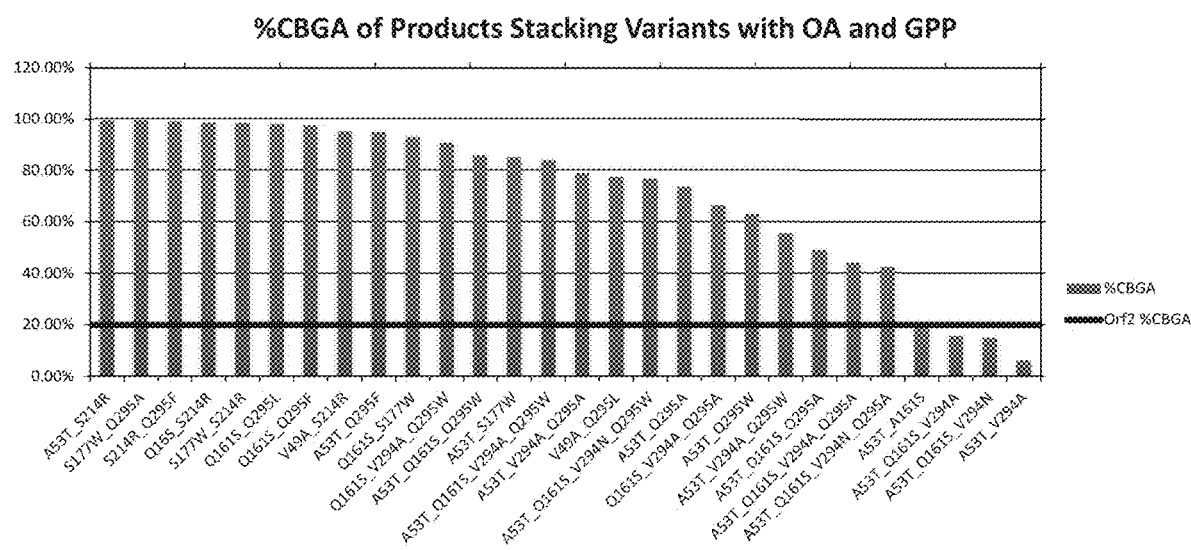
FIG. 21 shows the % CBGA produced (using OA as substrate and GPP as donor) by ORF2 stacking mutants.
Figure 22:
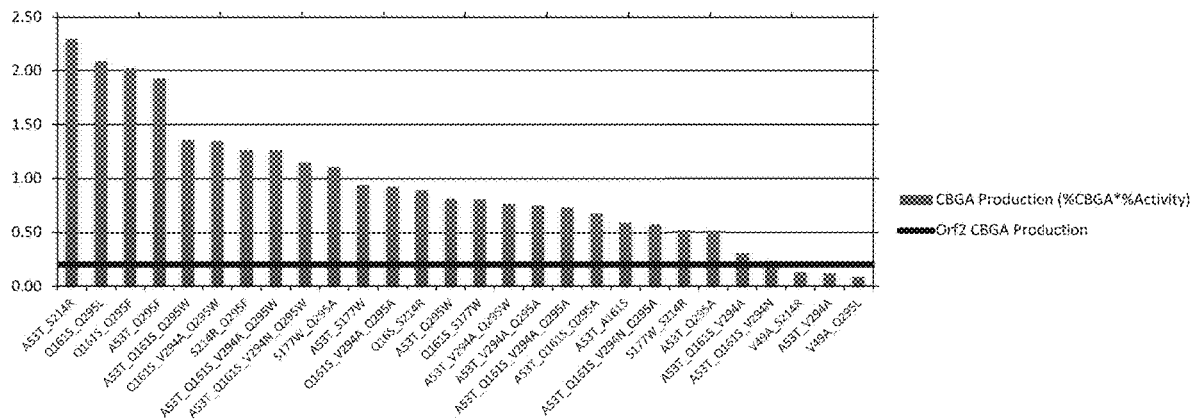
FIG. 22 shows the CBGA production potential (using OA as substrate and GPP as donor) of ORF2 stacking mutants.

Finally, ORF2 stacking mutants, that carry different novel combinations of the mutations identified by our analysis as being important for ORF2's enzymatic activity, were analyzed to determine the total amount of prenylated products they produce (FIG. 19); % enzymatic activity (FIG. 20), % CBGA (FIG. 21), and CBGA production potential (FIG. 22). Table 8 provides a summary of the enzymatic function, using OA as substrate and GPP as donor, for each of the stacking mutants. The analysis of the stacking mutants shows that multiple stacking mutants have significantly higher % enzymatic activity, % CBGA, and CBGA production potential, compared to the WT ORF2 or either singleton substitution variant on its own, thereby indicating that the ORF2 stacking mutants disclosed herein have synergistically enhanced effects compared to the individual single mutants. Thus, the ORF2 stacking mutants disclosed herein have unexpectedly superior enzymatic functions, in a reaction using OA and GPP, as compared to WT ORF2.

For instance, ORF2 double mutants, A53T-S214R; Q161S-Q295L; Q161S-Q295F; S177W-Q295A have synergistically enhanced CBGA production potential and % activity as compared to either of the single mutants. See FIGS. 82-85.

More stacking mutants will be generated as described above, based on the breakdown analysis of triple mutants, G12, C06 and F08, and planned site saturation mutagenesis experiments described above. These stacking mutants will further be analyzed to determine their % enzymatic activity, % CBGA, %5-GOA and CBGA production potential.

TABLE 8

| Mutations | OA | CBGA | 5-GOA | nMol CBGA | nMol 5-GOA |
|---|---|---|---|---|---|
| A53T_S214R | 30.1449 | 62.6579 | 0.1069 | 16.5019489 | 0.07057037 |
| Q161S_Q295L | 29.7788 | 57.0803 | 0.4619 | 15.0329997 | 0.30492474 |
| Q161S_Q295F | 29.5883 | 55.4403 | 0.6309 | 14.6010798 | 0.41649063 |
| A53T_Q295F | 30.0898 | 52.6928 | 1.1825 | 13.8774822 | 0.78063111 |
| A53T_Q161S_Q295W | 32.3733 | 68.7659 | 4.4902 | 18.1105873 | 2.9642197 |
| Q161S_V294A_Q295W | 39.2778 | 68.3285 | 2.8122 | 17.9953911 | 1.8564827 |
| S214R_Q295F | 43.7129 | 34.6447 | 0.1255 | 9.12422965 | 0.08284922 |
| A53T_Q161S_V294A_Q295W | 33.6064 | 63.9702 | 4.908 | 16.8475639 | 3.24003169 |
| A53T_Q161S_V294N_Q295W | 36.0016 | 58.018 | 7.059 | 15.2799579 | 4.66002112 |
| S177W_Q295A | 39.381 | 56.035 | 0.1016 | 14.7577035 | 0.06707156 |
| A53T_S177W | 54.8833 | 25.6741 | 1.8121 | 6.76168027 | 1.19626353 |
| Q161S_V294A_Q295A | 37.0068 | 46.9066 | 9.5266 | 12.3535949 | 6.28901505 |
| Q16S_S214R | 58.7858 | 24.2694 | 0.1169 | 6.39173031 | 0.0771719 |
| A53T_Q295W | 44.9864 | 41.0901 | 9.6799 | 10.8217277 | 6.39021653 |
| Q161S_S177W | 54.4823 | 21.9926 | 0.6705 | 5.79209903 | 0.44263269 |
| A53T_V294A_Q295W | 48.2017 | 38.5309 | 12.362 | 10.1477219 | 8.16081331 |
| A53T_V294A_Q295A | 50.4412 | 37.8163 | 4.0888 | 9.95952067 | 2.69923422 |
| A53T_Q161S_V294A_Q295A | 29.5636 | 36.8247 | 18.7595 | 9.69836713 | 12.3841431 |
| A53T_Q161S_Q295A | 54.602 | 34.1016 | 14.121 | 8.98119568 | 9.32202271 |
| A53T_A161S | 31.9028 | 16.0001 | 24.5577 | 4.21387938 | 16.2118431 |
| A53T_Q161S_V294N_Q295A | 51.4284 | 28.9549 | 15.8073 | 7.62573084 | 10.435239 |
| S177W_S214R | 73.1056 | 14.1529 | 0.0913 | 3.72739004 | 0.06027198 |
| A53T_Q295A | 70.1304 | 26.0366 | 3.7553 | 6.85715038 | 2.47907314 |
| A53T_Q161S_V294A | 43.4482 | 15.381 | 33.5956 | 4.0508296 | 22.1782414 |
| A53T_Q161S_V294N | 51.6804 | 11.9604 | 27.5382 | 3.1499605 | 18.1794296 |
| V49A_S214R | 91.0858 | 3.4446 | 0.0741 | 0.90718989 | 0.04891735 |
| A53T_V294A | 37.5911 | 5.8761 | 36.6497 | 1.54756387 | 24.1944151 |
| V49A_Q295L | 81.26 | 2.3805 | 0.277 | 0.62694232 | 0.18286242 |

TABLE 8-continued

| Mutations | Total Product | % Activity | % CBGA | CBGA Production (% CBGA * % Activity) | %5-GOA |
|---|---|---|---|---|---|
| A53T_S214R | 16.5725193 | 229.69% | 99.57% | 2.29 | 0.43% |
| Q161S_Q295L | 15.3379245 | 212.58% | 98.01% | 2.08 | 1.99% |
| Q161S_Q295F | 15.0175704 | 208.14% | 97.23% | 2.02 | 2.77% |
| A53T_Q295F | 14.6581133 | 203.16% | 94.67% | 1.92 | 5.33% |
| A53T_Q161S_Q295W | 21.074807 | 157.59% | 85.93% | 1.35 | 14.07% |
| Q161S_V294A_Q295W | 19.8518738 | 148.45% | 90.65% | 1.35 | 9.35% |
| S214R_Q295F | 9.20707888 | 127.61% | 99.10% | 1.26 | 0.90% |
| A53T_Q161S_V294A_Q295W | 20.0875956 | 150.21% | 83.87% | 1.26 | 16.13% |
| A53T_Q161S_V294N_Q295W | 19.939979 | 149.11% | 76.63% | 1.14 | 23.37% |
| S177W_Q295A | 14.824775 | 110.86% | 99.55% | 1.10 | 0.45% |
| A53T_S177W | 7.95794381 | 110.29% | 84.97% | 0.94 | 15.03% |
| Q161S_V294A_Q295A | 18.64261 | 139.41% | 66.27% | 0.92 | 33.73% |
| Q16S_S214R | 6.46890222 | 89.66% | 98.81% | 0.89 | 1.19% |
| A53T_Q295W | 17.2119442 | 128.71% | 62.87% | 0.81 | 37.13% |
| Q161S_S177W | 6.23473172 | 86.41% | 92.90% | 0.80 | 7.10% |
| A53T_V294A_Q295W | 18.3085352 | 136.91% | 55.43% | 0.76 | 44.57% |
| A53T_V294A_Q295A | 12.6587549 | 94.66% | 78.68% | 0.74 | 21.32% |
| A53T_Q161S_V294A_Q295A | 22.0825103 | 165.13% | 43.92% | 0.73 | 56.08% |
| A53T_Q161S_Q295A | 18.3032184 | 136.87% | 49.07% | 0.67 | 50.93% |
| A53T_A161S | 20.4257225 | 283.09% | 20.63% | 0.58 | 79.37% |
| A53T_Q161S_V294N_Q295A | 18.0609698 | 135.06% | 42.22% | 0.57 | 57.78% |
| S177W_S214R | 3.78766203 | 52.50% | 98.41% | 0.52 | 1.59% |
| A53T_Q295A | 9.33622353 | 69.81% | 73.45% | 0.51 | 26.55% |
| A53T_Q161S_V294A | 26.229071 | 196.14% | 15.44% | 0.30 | 84.56% |
| A53T_Q161S_V294N | 21.3293901 | 159.50% | 14.77% | 0.24 | 85.23% |
| V49A_S214R | 0.95610724 | 13.25% | 94.88% | 0.13 | 5.12% |
| A53T_V294A | 25.741979 | 192.49% | 6.01% | 0.12 | 93.99% |
| V49A_Q295L | 0.80980475 | 11.22% | 77.42% | 0.09 | 22.58% |

Example 3: Generation of ORF2 Variants with Improved Enzymatic Function Using OA as Substrate and GPP as Donor Four triple mutants (D12 carrying A53T_E112D_G205M mutations; D6 carrying A53E_Q161A_V294N mutations; H9 carrying E112G_G205M_L298W mutations; and E9 carrying A53T_M106E_Q161S mutations) that had improved activity vs. the WT ORF2, based on FIG. 3 were analyzed further. A53 (which was present in 3 out of 4 clones) and E112, Q161, and G205 (which were present in 2 out of 4 clones) were identified as target residues for site saturation.

Figure 23:
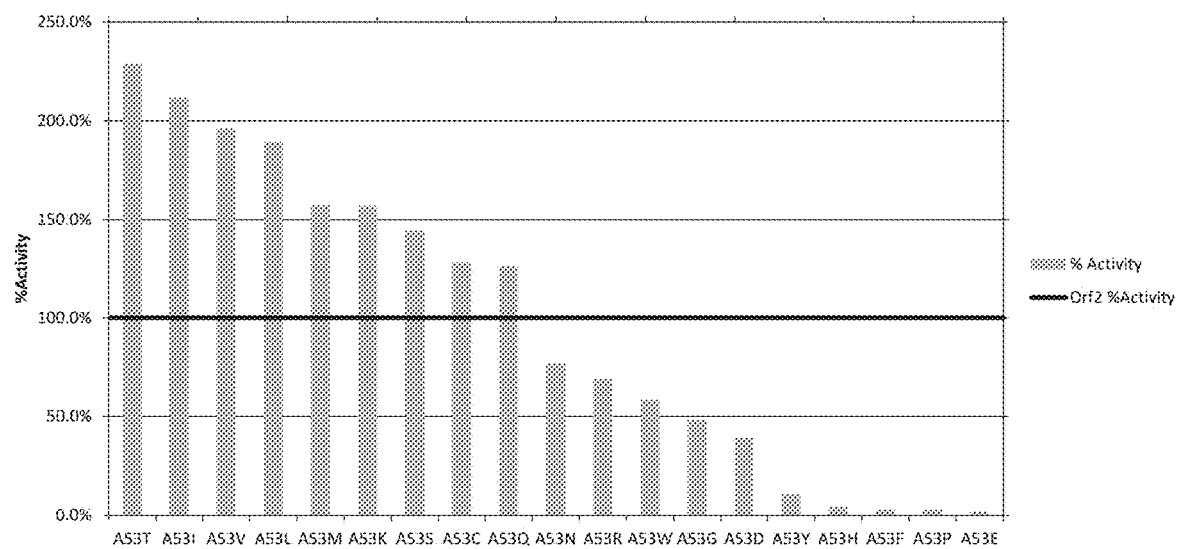
FIG. 23 shows the % ORF2 activity (using OA as substrate and GPP as donor) of A53 site saturation ORF2 mutants.

Site-saturated mutagenesis was done for A53 by replacing the wild type residue at this site with each of the 19 other standard amino acids. % of enzymatic activity as compared to WT ORF2 was measured. These results are depicted in FIG. 23 and Table 9.

Figure 24:
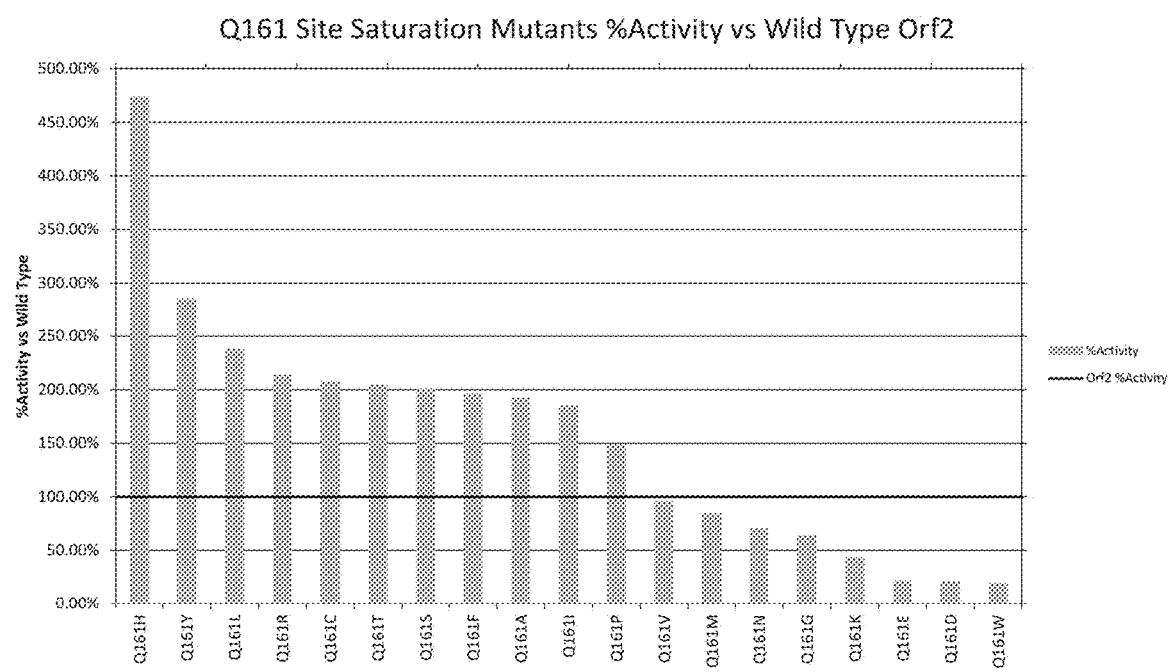
FIG. 24 shows % ORF2 activity (using OA as substrate and GPP as donor) of Q161 site saturation ORF2 mutants.

The site saturated mutants of Q161 described in Example 1 were also analyzed to determine their % activity in a reaction using OA as substrate and GPP as donor. These results are depicted in FIG. 24 and Table 10.

From the results described above, multiple mutations of A53 and Q161 that have significantly higher % activity, as compared to WT ORF2, were identified. Thus, the ORF2 mutants disclosed herein have unexpectedly superior enzymatic functions, in a reaction using OA as a substrate and GPP as donor, as compared to WT ORF2.

Similarly, site saturated mutagenesis will also be completed for E112 and G205 as described above; and % of enzymatic activity, as compared to WT ORF2, will be measured for each of these mutants.

TABLE 9

% activity of A53 site saturation mutants

| Mutations | nMol CBGA | nMol 5-GOA | Total Product | % Activity |
|---|---|---|---|---|
| A53T | 2.38941269 | 19.8774096 | 22.2668223 | 228.9% |
| A53I | 3.24627337 | 17.3253235 | 20.5715968 | 211.5% |
| A53V | 3.89741902 | 15.1585688 | 19.0559878 | 195.9% |
| A53L | 3.44464051 | 14.9749802 | 18.4196207 | 189.3% |
| A53M | 2.57000263 | 12.7041194 | 15.274122 | 157.0% |
| A53K | 1.96415591 | 13.2969369 | 15.2610928 | 156.9% |
| A53S | 2.15754543 | 11.8968841 | 14.0544295 | 144.5% |
| A53Q | 1.67719252 | 10.5953921 | 12.2725847 | 126.2% |
| A53N | 0.64851198 | 6.83212305 | 7.48063504 | 76.9% |
| A53R | 0.86465631 | 5.83100079 | 6.6956571 | 68.8% |
| A53W | 0.51358968 | 5.14932664 | 5.66291632 | 58.2% |
| A53G | 0.72675797 | 3.94533932 | 4.67209729 | 48.0% |
| A53D | 0.77882539 | 3.02079482 | 3.79962021 | 39.1% |
| A53Y | 0.19694496 | 0.82981252 | 1.02675747 | 10.6% |
| A53H | 0.10524098 | 0.3159493 | 0.42119028 | 4.3% |
| A53F | 0.14669476 | 0.12793768 | 0.27463244 | 2.8% |
| A53E | 0.0294443 | 0.16054925 | 0.18999355 | 2.0% |
| A53P | 0.0118778 | 0.25745973 | 0.26933753 | 0.02630185 |

TABLE 10

% activity of Q161 site saturation mutants

| Mutations | nMol CBGA | nMol 5-GOA | Total Product | % CBGA | % Activity | CBGA Production (% CBGA * % Activity) |
|---|---|---|---|---|---|---|
| Q161Y | 16.667843 | 0.85364405 | 17.5214871 | 0.95128016 | 285.5% | 2.7 |
| Q161R | 12.2930735 | 0.84948508 | 13.1425586 | 0.9353638 | 214.1% | 2.0 |

TABLE 10-continued

% activity of Q161 site saturation mutants

| Mutations | nMol CBGA | nMol 5-GOA | Total Product | % CBGA | % Activity | CBGA Production (% CBGA * % Activity) |
|---|---|---|---|---|---|---|
| Q161D | 21.4621807 | 0.13090837 | 21.593089 | 0.99393749 | 209.2% | 2.1 |
| Q161C | 1.25422702 | 11.5192105 | 12.7734375 | 0.09819025 | 208.1% | 0.2 |
| Q161T | 3.43850408 | 9.12661738 | 12.5651215 | 0.27365466 | 204.7% | 0.6 |
| Q161S | 4.32970766 | 8.01366517 | 12.3433728 | 0.35077185 | 201.1% | 0.7 |
| Q161F | 7.26028444 | 4.79073145 | 12.0510159 | 0.60246244 | 196.3% | 1.2 |
| Q161A | 0.94174348 | 12.9347769 | 13.8765203 | 0.06786597 | 192.3% | 0.1 |
| Q161I | 2.55794048 | 8.79852126 | 11.3564617 | 0.22524097 | 185.0% | 0.4 |
| Q161P | 0.40550435 | 14.9294956 | 15.335 | 0.02644306 | 148.5% | 0.0 |
| Q161M | 2.03963656 | 3.15209929 | 5.19173584 | 0.39286216 | 84.6% | 0.3 |
| Q161Q | 1.44664209 | 5.77105889 | 7.21770097 | 0.20042976 | 78.8% | 0.2 |
| Q161N | 1.50005267 | 4.96633219 | 6.46638486 | 0.23197702 | 70.6% | 0.2 |
| Q161G | 1.0237556 | 4.88599155 | 5.90974715 | 0.17323171 | 64.5% | 0.1 |
| Q161K | 1.7402423 | 1.38975442 | 3.12999672 | 0.55598854 | 43.4% | 0.2 |
| Q161W | 0.37682381 | 1.63856615 | 2.01538996 | 0.18697315 | 19.5% | 0.0 |

Example 4: Generation of ORF2 Variants which Synthesize an Altered Amount of CBGVA and/or 5-GDVA Compared to WT ORF2

The library of tripleton mutants described in Example 1, was screened for the ability to produce CBGVA and 5-GDVA using DVA as substrate and Geranyl pyrophosphate (GPP) as donor; and this enzymatic activity was compared to that of the WT ORF2. Table 5 provides the summary of the analysis performed on the enzymatic activity of the ORF2 triple mutants to produce CBGVA and 5-GDVA using DVA as substrate and Geranyl pyrophosphate (GPP) as donor. Table 11 lists the mutations within each of the tripleton mutants as well the nMol CBGVA, nMol of 5-GDVA, total prenylated products, % CBGVA products among prenylated products, % enzymatic activity, CBGVA production potential and %5-GDVA among total prenylated products of each of the ORF2 triple mutants.

TABLE 11

| CLONE ID | Mutations | nMol CBGVA | nMol 5-GDVA | Total Products | % CBGVA | % Activity | CBGVA Production Potential | %5-GOA |
|---|---|---|---|---|---|---|---|---|
| G12 | A17T_Q161W_A232S | 15.44563535 | 1.780798893 | 17.22643424 | 89.66% | 202.28% | 1.81 | 10.3375943 |
| A09 | V49A_Q161S_V294A | 13.27689212 | 2.418751236 | 15.69564336 | 84.59% | 206.78% | 1.75 | 15.4103351 |
| H03 | A17T_F213M_S214R | 4.132448537 | 0.488308286 | 4.620756823 | 89.43% | 67.42% | 0.60 | 10.5677123 |
| H02 | A53Q_S177W_L219F | 3.203799721 | 2.079716235 | 5.283515956 | 60.64% | 62.04% | 0.38 | 39.3623536 |
| C05 | A53Q_S177Y_Y288H | 2.742222566 | 0.457534111 | 3.199756677 | 85.70% | 42.15% | 0.36 | 14.2990282 |
| E09 | A53T_M106E_Q161S | 3.030297168 | 7.080383627 | 10.11068079 | 29.97% | 118.73% | 0.36 | 70.0287525 |
| F08 | A53T_N173D_S214R | 2.498181396 | 1.595881946 | 4.094063342 | 61.02% | 48.08% | 0.29 | 38.9803922 |
| D04 | A53T_D166E_Q295W | 1.938244854 | 2.469102235 | 4.407347088 | 43.98% | 58.06% | 0.26 | 56.0224141 |
| H11 | A108G_Q161S_G205M | 2.059394831 | 2.31374827 | 4.3731431 | 47.09% | 51.35% | 0.24 | 52.9081308 |
| D06 | A53E_Q161A_V294N | 1.045658567 | 3.092891042 | 4.138549609 | 25.27% | 54.52% | 0.14 | 74.733695 |
| A10 | V49S_K118Q_S177E | 0.813341588 | 0.932123789 | 1.745465377 | 46.60% | 23.00% | 0.11 | 53.402594 |
| G07 | V49S_Y216A_V294N | 0.898003405 | 0.146628436 | 1.044631841 | 85.96% | 12.27% | 0.11 | 14.0363744 |
| C11 | E112D_L219F_V294F | 0.771126761 | 5.599490805 | 6.370617565 | 12.10% | 83.93% | 0.10 | 87.8955729 |
| C06 | Q161A_M162F_Q295A | 0.737424547 | 0.764830927 | 1.502255475 | 49.09% | 19.79% | 0.10 | 50.9121744 |
| H08 | M106E_M162A_Y216A | 0.768650364 | 0.224120032 | 0.992770395 | 77.42% | 11.41% | 0.09 | 22.575213 |
| A04 | L219F_V294N_Q295A | 0.652569262 | 3.246737196 | 3.899306458 | 16.74% | 51.37% | 0.09 | 83.2644787 |
| A05 | A17T_C25V_E112G | 0.648467729 | 6.486380826 | 7.134847994 | 9.09% | 94.00% | 0.09 | 90.9112608 |
| C08 | V49S_S214G_V294A | 0.547012846 | 0.777733834 | 1.324746681 | 41.29% | 17.45% | 0.07 | 58.7081172 |
| D12 | A53T_E112D_G205M | 0.548754063 | 11.45797904 | 12.0067331 | 4.57% | 140.99% | 0.06 | 95.4296139 |
| H10 | M162A_N173D_S214F | 0.437741836 | 1.19524916 | 1.632990995 | 26.81% | 19.18% | 0.05 | 73.193861 |
| H09 | E112G_G205M_L298W | 0.332843213 | 3.759738496 | 4.092582189 | 8.13% | 48.06% | 0.04 | 91.8671587 |
| G05 | A53T_K118N_S214F | 0.321157716 | 0.749060708 | 1.070218423 | 30.01% | 12.57% | 0.04 | 69.991386 |
| F09 | Q38G_D166E_Q295A | 0.295774648 | 0.495624876 | 0.791399524 | 37.37% | 9.29% | 0.03 | 62.6263804 |
| D11 | F123H_L174V_S177E | 0.215059588 | 0.421939885 | 0.636999474 | 33.76% | 7.48% | 0.03 | 66.2386553 |
| B09 | C25V_F213M_Y216A | 0.166228138 | 0.315379265 | 0.48160781 | 34.52% | 6.34% | 0.02 | 65.4847503 |
| C01 | V49S_M162A_Y283L | 0.139142548 | 1.386320941 | 1.525463489 | 9.12% | 20.10% | 0.02 | 90.8786707 |
| D07 | K119A_S214G_L298A | 0.128347005 | 0.796470239 | 0.924817244 | 13.88% | 10.86% | 0.02 | 86.1219062 |
| G03 | L219F_Y283L_L298W | 0.1271475 | 1.259392921 | 1.386540421 | 9.17% | 16.28% | 0.01 | 90.8298742 |
| H01 | K119A_Q161A_R228Q | 0.125715833 | 0.073017599 | 0.198733433 | 63.26% | 2.33% | 0.01 | 36.7414774 |
| C12 | N173D_F213M_V294F | 0.109038848 | 6.163140202 | 6.27217905 | 1.74% | 82.63% | 0.01 | 98.2615476 |
| D03 | D227E_C230N_Q295W | 0.079863798 | 0.046247775 | 0.126111574 | 63.33% | 1.66% | 0.01 | 36.6721103 |
| A02 | Q38G_E112D_F123H | 0.078509519 | 0.064119043 | 0.142628562 | 55.04% | 1.88% | 0.01 | 44.9552616 |
| G02 | A53E_F213M_R228Q | 0.063728525 | 3.011332316 | 3.074851721 | 2.07% | 44.86% | 0.01 | 97.9274277 |
| A03 | V49L_F123A_Y283L | 0.079089924 | 0.065948191 | 0.145038115 | 54.53% | 1.70% | 0.01 | 45.4695586 |
| G04 | D227E_R228E_L298Q | 0.064231543 | 0.496761914 | 0.560993457 | 11.45% | 6.59% | 0.01 | 88.5503935 |
| A03 | V49L_F123A_Y283L | 0.054867668 | 0.61311054 | 0.667978207 | 8.21% | 8.80% | 0.01 | 91.7860093 |
| B08 | K118Q_L174V_R228Q | 0.041363566 | 0.565651572 | 0.607015138 | 6.81% | 8.00% | 0.01 | 93.1857439 |
| E10 | E112D_K119A_N173D | 0.041595728 | 0.173002768 | 0.214598497 | 19.38% | 2.52% | 0.00 | 80.6169527 |

TABLE 11-continued

| CLONE ID | Mutations | nMol CBGVA | nMol 5-GDVA | Total Products | % CBGVA | % Activity | CBGVA Production Potential | %5-GOA |
|---|---|---|---|---|---|---|---|---|
| F12 | A17T_V49A_C230N | 0.026234329 | 0.084017204 | 0.110251533 | 23.79% | 1.29% | 0.00 | 76.2050211 |
| D09 | K118N_C209G_R228Q | 0.023951401 | 0.015300573 | 0.039251974 | 61.02% | 0.46% | 0.00 | 38.9803922 |
| A08 | C25V_A232S_V271E | 0.016019192 | 0.027906862 | 0.043926054 | 36.47% | 0.58% | 0.00 | 63.5314565 |
| D10 | V49A_F123A_Y288H | 0.015825724 | 0.010109749 | 0.025935472 | 61.02% | 0.30% | 0.00 | 38.9803922 |
| E08 | F123H_L274V_L298A | 0.010021668 | 0.090493376 | 0.100515044 | 9.97% | 1.69% | 0.00 | 90.029683 |
| D08 | E112D_K119A_N173D | 0.009557344 | 0.066590864 | 0.076148208 | 12.55% | 0.89% | 0.00 | 87.449023 |
| G11 | S177W_Y288H_V294N | 0.009479957 | 0.008305319 | 0.017785276 | 53.30% | 0.21% | 0.00 | 46.6977254 |
| D01 | K118Q_Q161W_S214F | 0.007080947 | 0.458745304 | 0.465826251 | 1.52% | 6.14% | 0.00 | 98.4799167 |
| H07 | F123A_M162F_S214G | 0.007080947 | 0.046099466 | 0.053180413 | 13.31% | 0.62% | 0.00 | 86.6850467 |
| H06 | V49L_E112D_G286E | 0.006229686 | 0.006896381 | 0.013126067 | 47.46% | 0.15% | 0.00 | 52.5395857 |
| H05 | S177E_S214R_R228E | 0.006152298 | 0.008503065 | 0.014655363 | 41.98% | 0.17% | 0.00 | 58.0201581 |
| F10 | K119D_Q161W_L298Q | 0.006074911 | 0.032603322 | 0.038678233 | 15.71% | 0.45% | 0.00 | 84.2937215 |
| A11 | V49L_D166E_L274V | 0.004527163 | 0.018316195 | 0.022843358 | 19.82% | 0.30% | 0.00 | 80.1817101 |
| G08 | F123W_M162F_C209G | 0.005068875 | 0.015943247 | 0.021012122 | 24.12% | 0.25% | 0.00 | 75.8764258 |
| B04 | A53E_A108G_K118N | 0.003714595 | 0.042193989 | 0.045908584 | 8.09% | 0.60% | 0.00 | 91.908713 |
| C10 | A53Q_L274V_Q295A | 0.003675902 | 0.187685387 | 0.191361288 | 1.92% | 2.52% | 0.00 | 98.0790777 |
| G10 | V49A_Y121W_C230S | 0.003985451 | 0.011073759 | 0.01505921 | 26.47% | 0.18% | 0.00 | 73.5347931 |
| G09 | M106E_G205L_C209G | 0.003908064 | 0.011123196 | 0.015031259 | 26.00% | 0.18% | 0.00 | 74.0004235 |
| G06 | K118Q_F123A_R228E | 0.003288965 | 0.027288906 | 0.030577871 | 10.76% | 0.36% | 0.00 | 89.2439714 |
| H04 | M162A_C209G_Y288H | 0.003095496 | 0.014435436 | 0.017530932 | 17.66% | 0.21% | 0.00 | 82.3426613 |
| C07 | V49L_K119D_G205M | 0.002515091 | 0.031491003 | 0.034006093 | 7.40% | 0.45% | 0.00 | 92.6040003 |
| A07 | G205L_R228E_C230N | 0.001818604 | 0.101270516 | 0.10308912 | 1.76% | 1.36% | 0.00 | 98.2358915 |
| C03 | V49L_S214R_V271E | 0.001625135 | 0.030205656 | 0.031830791 | 5.11% | 0.42% | 0.00 | 94.8944548 |
| G08 | F123W_M162F_C209G | 0.00177991 | 0.035174016 | 0.036953926 | 4.82% | 0.44% | 0.00 | 95.1834341 |
| B06 | D166E_S177Y_S214F | 0.001392973 | 0.030823611 | 0.032216584 | 4.32% | 0.42% | 0.00 | 95.6762231 |
| B05 | A53Q_Y121W_A232S | 0.001392973 | 0.031688748 | 0.033081721 | 4.21% | 0.44% | 0.00 | 95.7892964 |
| B02 | V49A_S177Y_C209G | 0.001083424 | 0.039351394 | 0.040434818 | 2.68% | 0.53% | 0.00 | 97.3205676 |
| B10 | M106E_Y121W_D166E | 0.000812568 | 0.027807989 | 0.028620557 | 2.84% | 0.38% | 0.00 | 97.1608948 |
| B11 | V49S_K119D_F213M | 0.000773874 | 0.028722563 | 0.029496437 | 2.62% | 0.39% | 0.00 | 97.3763814 |
| A12 | Y121W_S177Y_G286E | 0.000464324 | 0.031589875 | 0.0320542 | 1.45% | 0.42% | 0.00 | 98.5514397 |
| C09 | A108G_K119D_L298A | 0.000348243 | 0.03512458 | 0.035472823 | 0.98% | 0.47% | 0.00 | 99.0182814 |
| C02 | K118N_K119A_V271E | 0.000116081 | 0.018711687 | 0.018827768 | 0.62% | 0.25% | 0.00 | 99.383458 |

Figure 25:
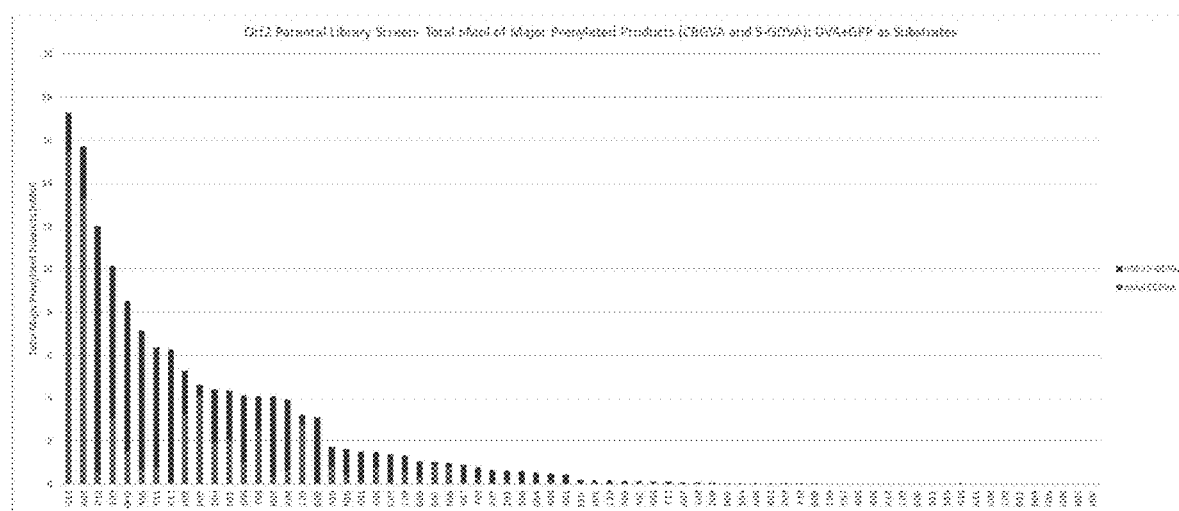
FIG. 25 shows the total nMol of prenylated products produced by ORF2 mutants using DVA as substrate and GPP as donor.

The amount of CBGVA or 5-GDVA (in nMols) generated by each of the ORF2 triple mutant clones was measured using HPLC. FIG. 25 shows the total nMols of prenylated products generated using DVA as substrate and GPP as donor by each of the ORF2 triple mutants, and the proportion of CBGVA and 5-GDVA within the total prenylated products. An exemplary wild type ORF2 replicate is included in the graph for comparison purposes.

Figure 26:
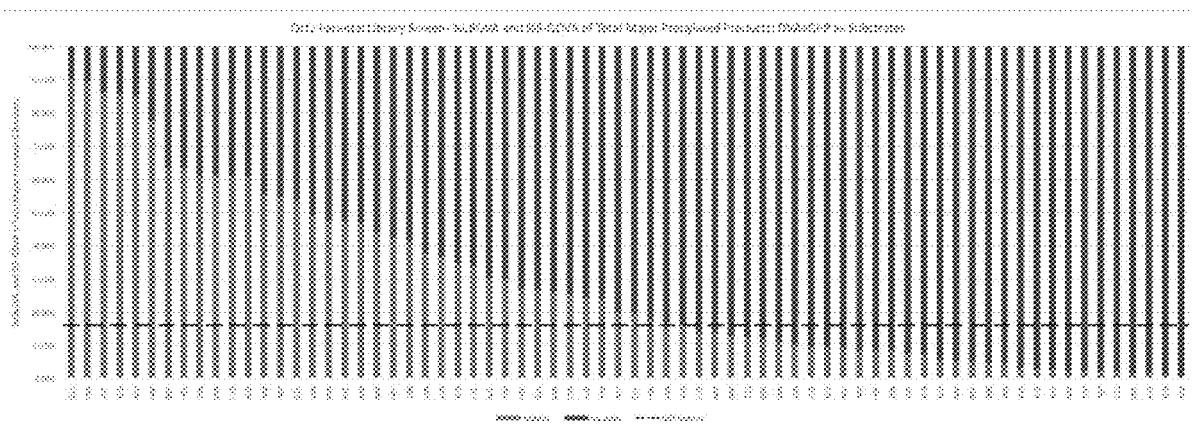
FIG. 26 shows % CBGVA and %5-GDVA produced by ORF2 mutants using DVA as substrate and GPP as donor.

FIG. 26 shows the % CBGVA and %5-GDVA within the total prenylated products produced by each of the ORF2 mutant clones, using DVA as substrate and GPP as donor. In this graph, the mutant clones are ordered based on decreasing % CBGA (from left to right) they produce, with the %5-GDVA depicted in red. The black threshold line on the graph indicates the % CBGVA that is produced by the wild type enzyme.

Figure 27:
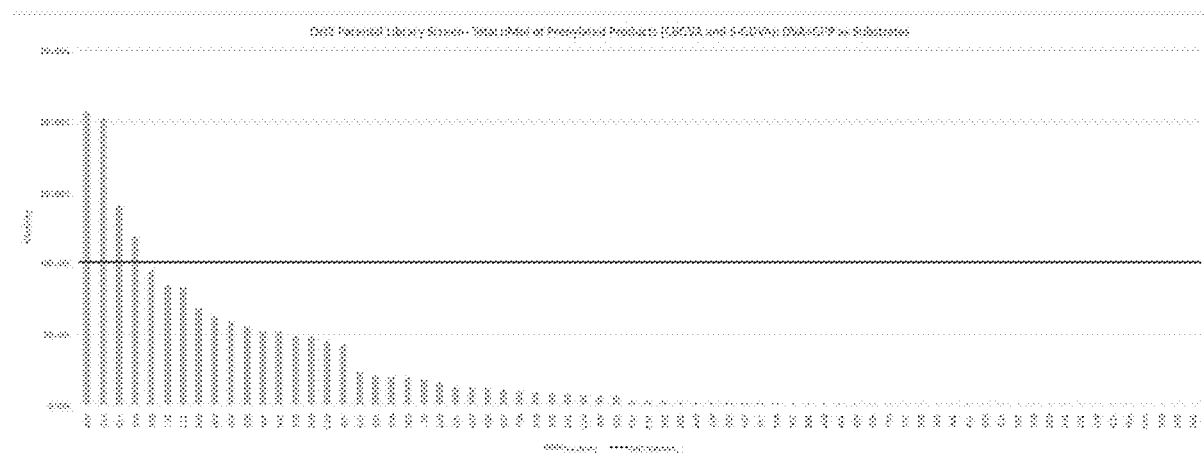
FIG. 27 shows the % enzymatic activity of ORF2 mutants using DVA as substrate and GPP as donor.

FIG. 27 shows the % ORF2 enzymatic activity (using DVA as substrate and GPP as donor) of each of the mutant ORF2 clones relative to the wild type enzyme. % activity was calculated by dividing the nMols of total prenylated products produced by a mutant by the nMols of total prenylated products produced by the wild type control, and expressed as a percentage. The red threshold line represents the wild type Orf2% activity.

Figure 28:
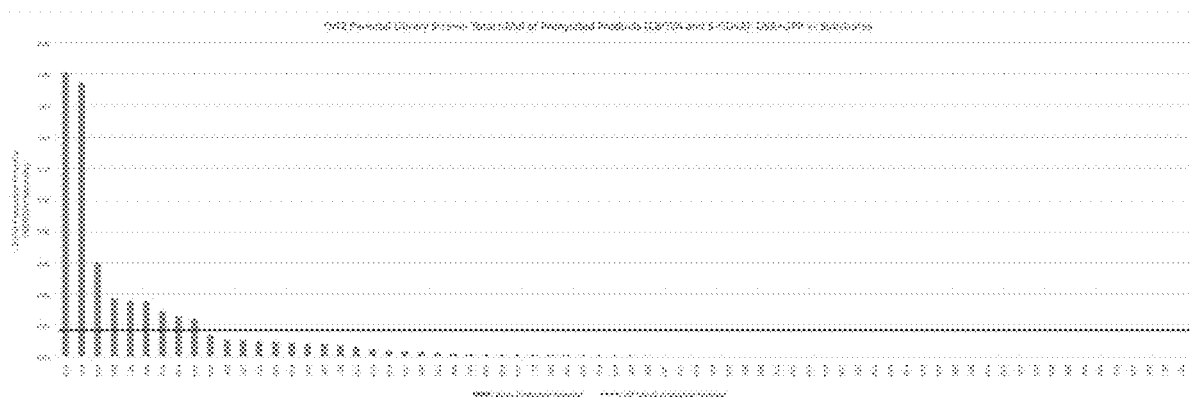
FIG. 28 shows the CBGVA production potential of ORF2 mutants using DVA as substrate and GPP as donor.
Figure 29:
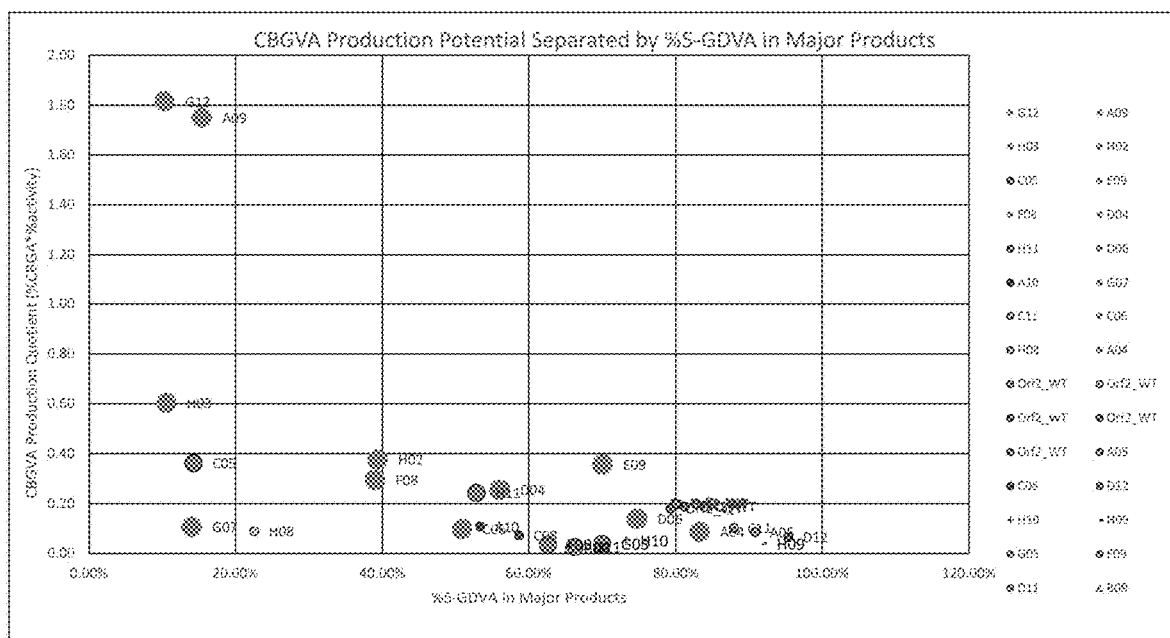
FIG. 29 shows a cluster map of ORF2 mutants clustered based on CBGVA production potential and % GDVA produced, using DVA as substrate and GPP as donor

FIG. 28 shows the CBGVA production potential of each of the ORF2 mutant clones when using DVA as substrate and GPP as donor. CBGVA production potential (interchangeably referred to herein as CBGVA production quotient) represents the improvement in CBGVA production vs. the wild type enzyme. CBGVA production potential was calculated by multiplying the % CBGVA of the Total Products by the % Activity of each mutant. The red threshold line on the graph represents this wild type value.

While the CBGVA production potential analysis shown in FIG. 28 is useful to rank ORF2 mutant clones based on the amount of CBGVA produced, such an analysis would not differentiate between a mutant that made 100% CBGVA but was 20% as active as wildtype ORF2; or a mutant that made 10% CBGVA and was 200% as active as wild type ORF2. Therefore, a cluster analysis was employed by plotting the CBGVA Production Potential vs. %5-GDVA (FIG. 29). %5-GDVA was calculated in a similar manner as % CBGVA. We used the top 25 mutants ranked based on their CBGVA production potential for this analysis. High 5-GDVA producing mutants cluster together towards the right of the graph and high CBGVA producing mutants cluster towards the left of the graph.

Based on the analysis performed in FIG. 29, 24 mutants which cluster to the left of the graph were selected (Table 12). These clones were targeted for "breakdown" analysis.

TABLE 12

| CBGVA Production Rank | Clone ID | Mutations | Targeted for Breakdown |
|---|---|---|---|
| 1 | G12 | A17T_Q161W_A232S | YES |
| 2 | A09 | V49A_Q161S_V294A | YES |
| 3 | H03 | A17T_F213M_S214R | YES |
| 4 | H02 | A53Q_S177W_L219F | YES |

TABLE 12-continued

| CBGVA Production Rank | Clone ID | Mutations | Targeted for Breakdown |
|---|---|---|---|
| 5 | C05 | A53Q_S177Y_Y288H | YES |
| 6 | E09 | A53T_M106E_Q161S | YES |
| 7 | F08 | A53T_N173D_S214R | YES |
| 8 | D04 | A53T_D166E_Q295W | YES |
| 9 | H11 | A108G_Q161S_G205M | YES |
| 10 | D06 | A53E_Q161A_V294N | YES |
| 11 | A10 | V49S_K118Q_S177E | YES |
| 12 | G07 | V49S_Y216A_V294N | YES |
| 14 | C06 | Q161A_M162F_Q295A | YES |
| 15 | H08 | M106E_M162A_Y216A | YES |
| 16 | A04 | L219F_V294N_Q295A | YES |
| 18 | C08 | V49S_S214G_V294A | YES |
| 20 | H10 | M162A_N173D_S214F | YES |
| 22 | G05 | A53T_K118N_S214F | YES |
| 23 | F09 | Q38G_D166E_Q295A | YES |
| 24 | D11 | F123H_L174V_S177E | YES |

For the singleton and doubleton mutants resulting from the breakdown of triple mutants—A09; H02; C05; E09; D04; H11; A04; G05; F09; and D11—the total amount of prenylated products (and the respective proportion of CBGVA and 5-GDVA); and % CBGVA within the prenylated products was calculated.

For the remaining triple mutants in Table 6, the breakdown of the triple mutants into singletons and doubletons; and the determination of the total amount of prenylated products and % CBGVA produced by these mutants will be determined.

Figure 30A:
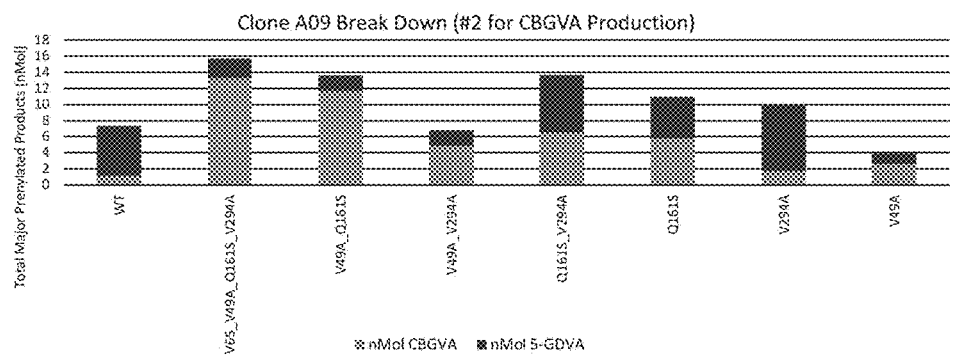
FIG. 30 shows the total amount of prenylated products (FIG. 30A) and % CBGVA in prenylated products (FIG. 30B) of A09 ORF2 mutant using DVA as substrate and GPP as donor.
Figure 30B:
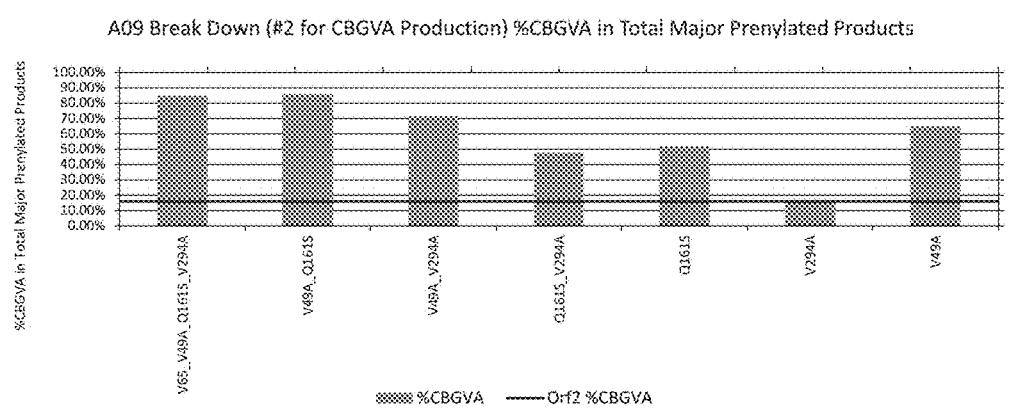
Figure 31A:
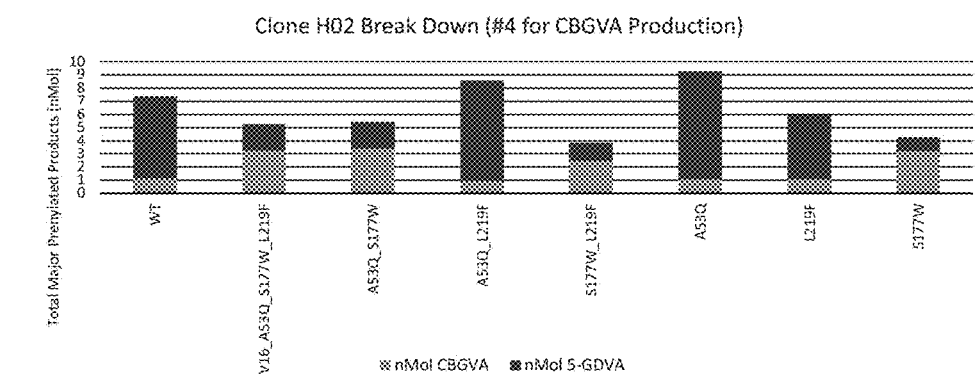
FIG. 31 shows the total amount of prenylated products (FIG. 31A) and % CBGVA in prenylated products (FIG. 1B) of H02 ORF2 mutant using DVA as substrate and GPP as donor.
Figure 31B:
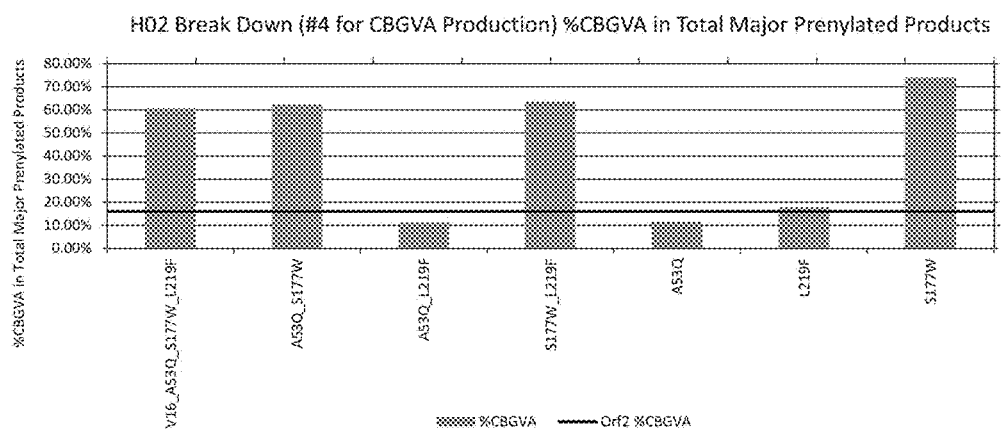
Figure 32A:
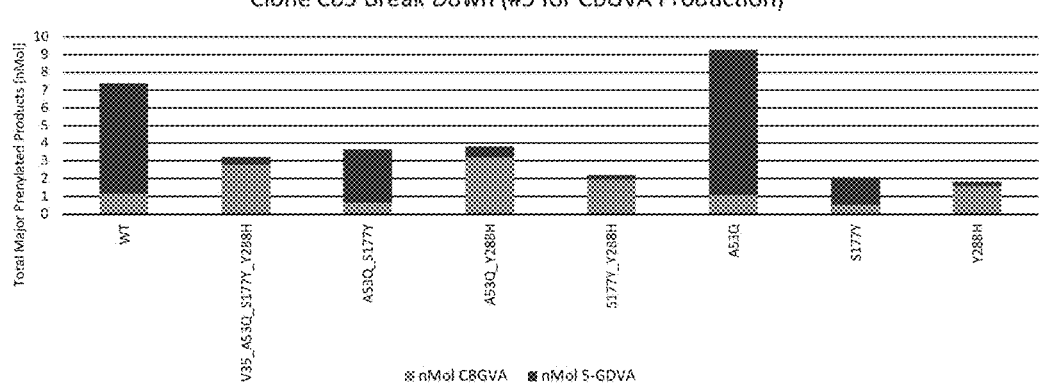
FIG. 32 shows the total amount of prenylated products (FIG. 32A) and % CBGVA in prenylated products (FIG. 32B) of C05 ORF2 mutant using DVA as substrate and GPP as donor.
Figure 32B:
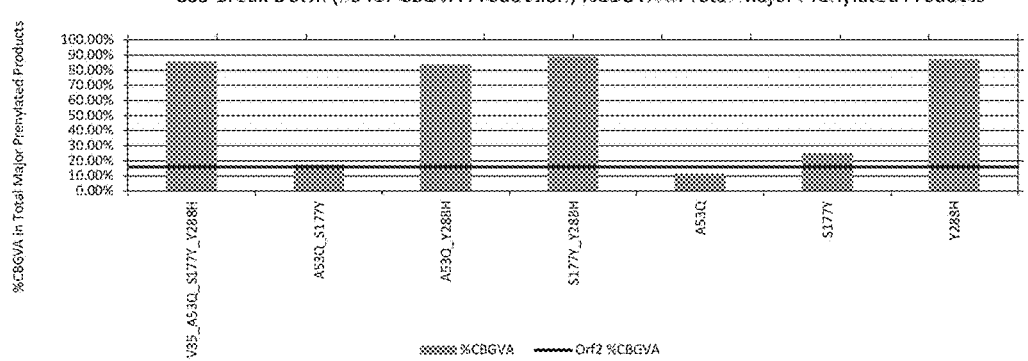
Figure 33A:
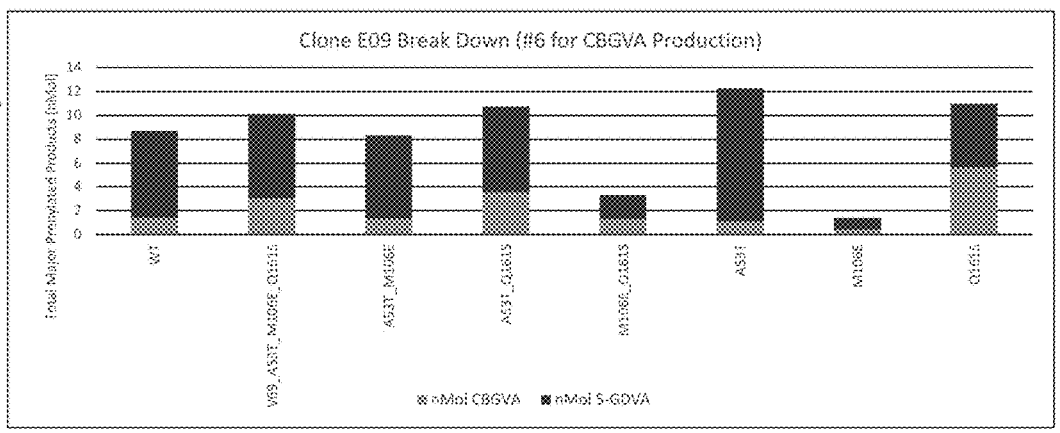
FIG. 33 shows the total amount of prenylated products (FIG. 33A) and % CBGVA in prenylated products (FIG. 33B) of E09 ORF2 mutant using DVA as substrate and GPP as donor.
Figure 33B:
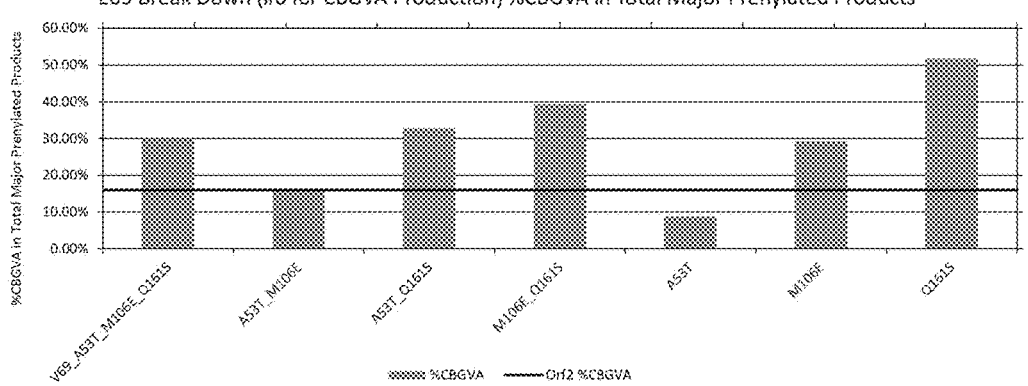
Figure 34A:
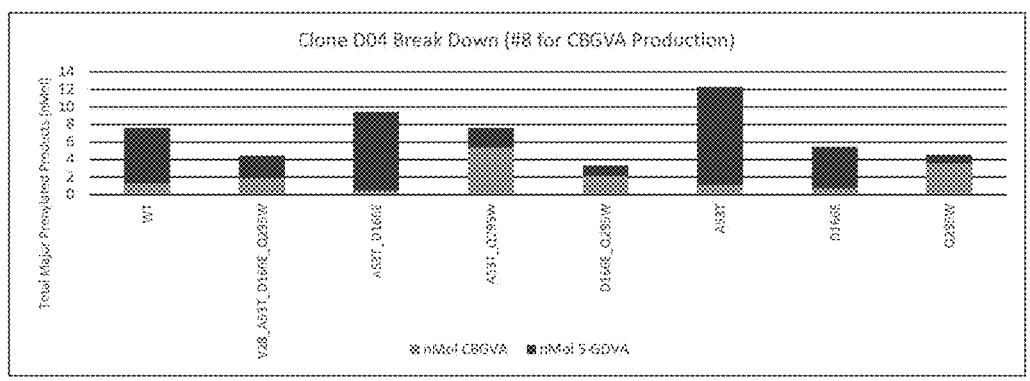
FIG. 34 shows the total amount of prenylated products (FIG. 34A) and % CBGVA in prenylated products (FIG. 34B) of D04 ORF2 mutant using DVA as substrate and GPP as donor.
Figure 34B:
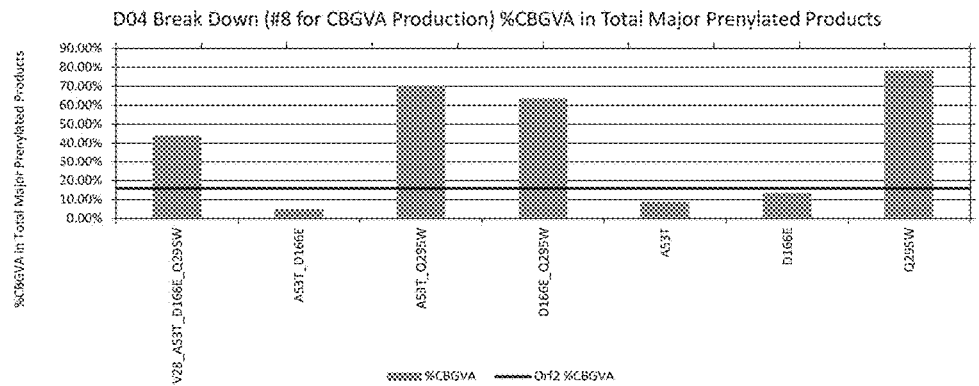
Figure 35A:
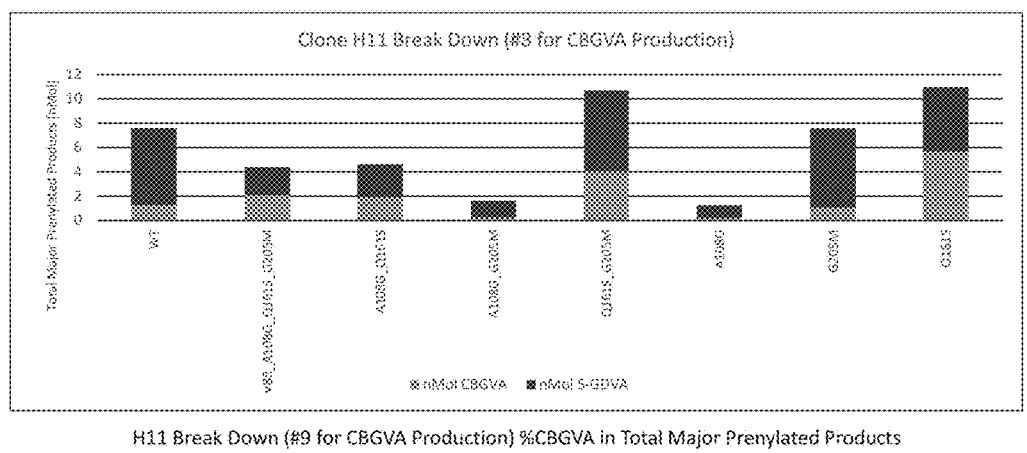
FIG. 35 shows the total amount of prenylated products (FIG. 35A) and % CBGVA in prenylated products (FIG. 35B) of H11 ORF2 mutant using DVA as substrate and GPP as donor.
Figure 35B:
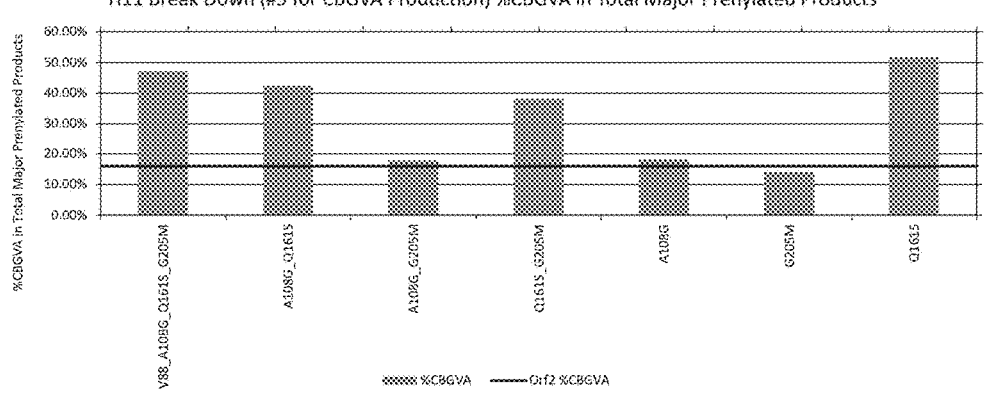
Figure 37A:
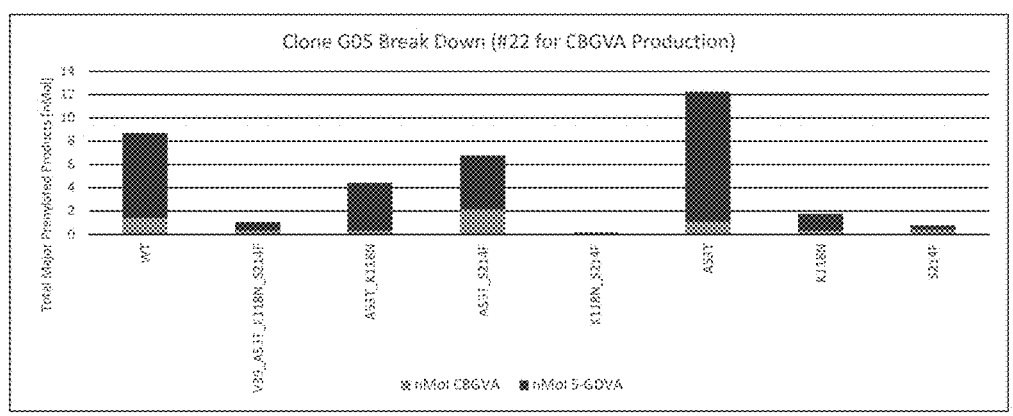
FIG. 37 shows the total amount of prenylated products (FIG. 37A) and % CBGVA in prenylated products (FIG. 37B) of G05 ORF2 mutant using DVA as substrate and GPP as donor.
Figure 37B:
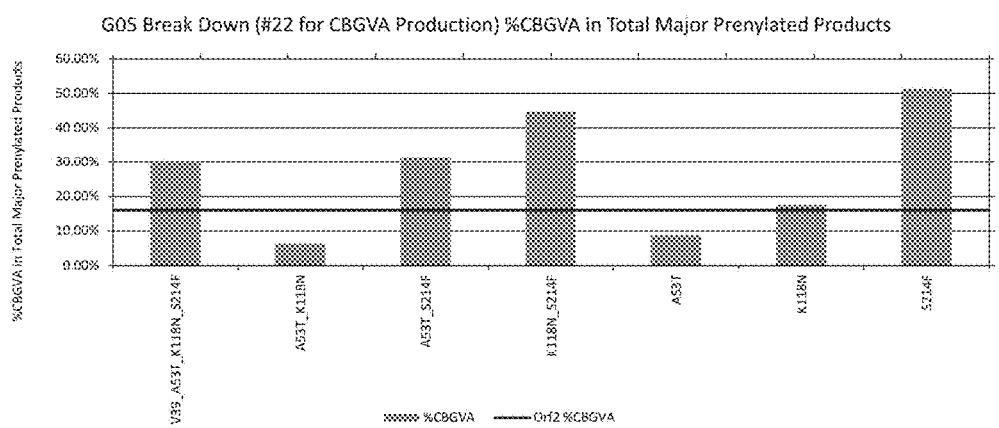
Figure 38A:
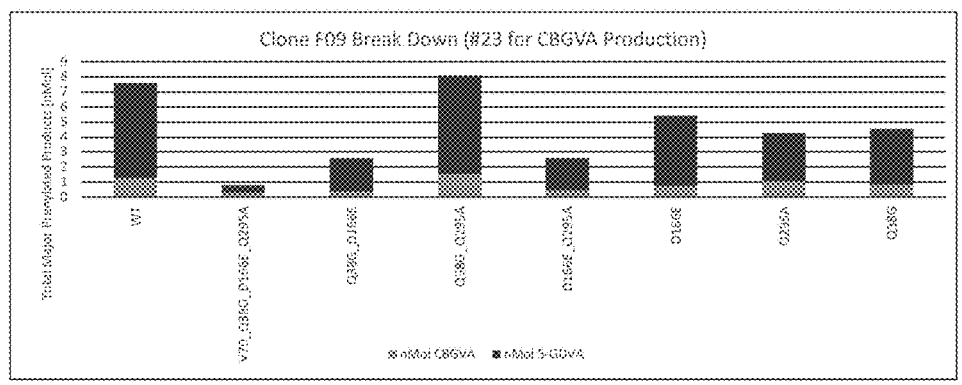
FIG. 38 shows the total amount of prenylated products (FIG. 38A) and % CBGVA in prenylated products (FIG. 38B) of F09 ORF2 mutant using DVA as substrate and GPP as donor.
Figure 38B:
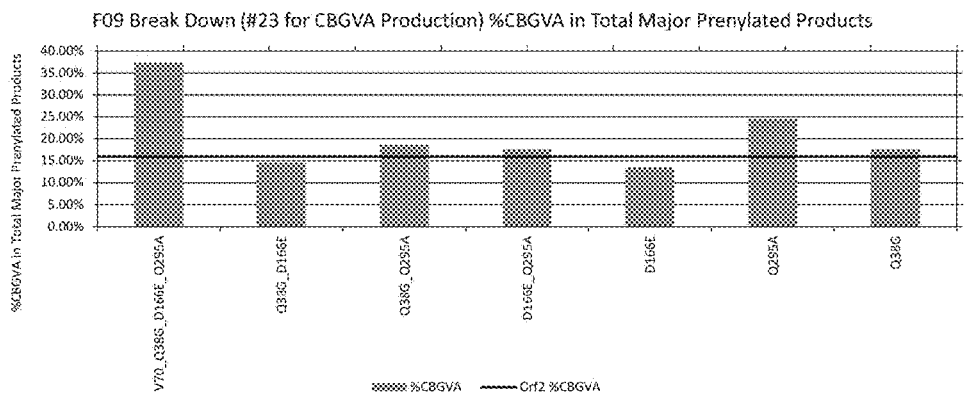
Figure 39A:
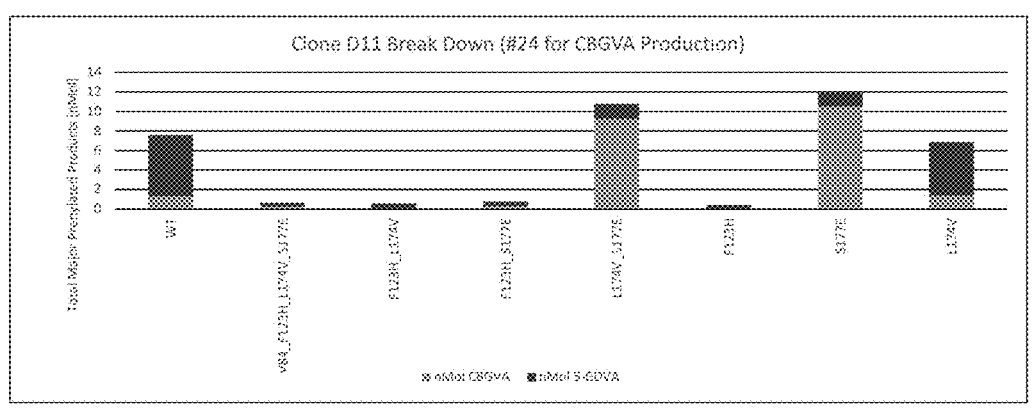
FIG. 39 shows the total amount of prenylated products (FIG. 39A) and % CBGVA in prenylated products (FIG. 39B) of D11 ORF2 mutant using DVA as substrate and GPP as donor.
Figure 39B:
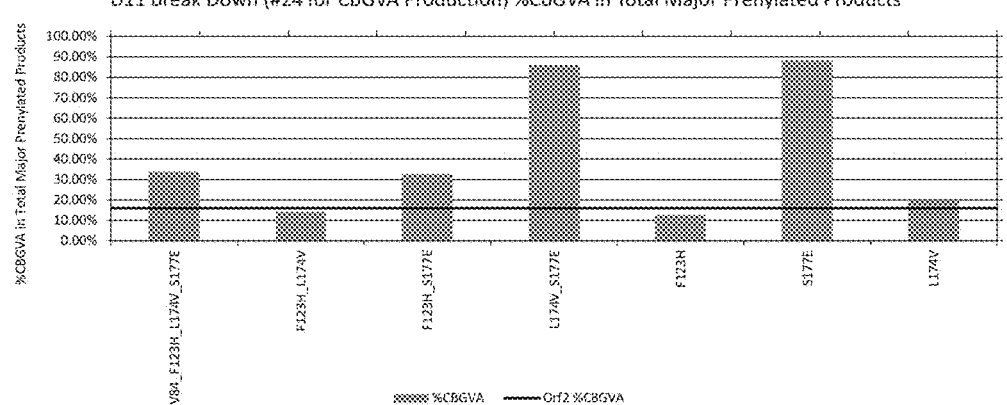

FIGS. 30-39 depict the total amount of prenylated products and % CBGVA produced using DVA as substrate and GPP as donor for the mutants derived from A09 (FIG. 30); H02 (FIG. 31); C05 (FIG. 32); E09 (FIG. 33); D04 (FIG. 34); H11 (FIG. 35); A04 (FIG. 36); G05 (FIG. 37); F09 (FIG. 38); and D11 (FIG. 39). The % CBGVA for these clones, along with the mutations they carry, are listed in Table 13.

TABLE 13

| RBP CLONE ID | Mutations | % CBGVA |
|---|---|---|
| A09 | V49A_Q161S_V294A | 84.59% |
| 022 | V49A_Q161S | 85.83% |
| 023 | V49A_V294A | 71.18% |
| 024 | Q161S_V294A | 47.59% |
| 041 | Q161S | 51.78% |
| 049 | V294A | 16.99% |
| 051 | V49A | 64.92% |
| H02 | A53Q_S177W_L219F | 60.64% |
| 007.1 | A53Q_S177W | 62.28% |
| 008 | A53Q_L219F | 11.13% |
| 009 | S177W_L219F | 63.48% |
| 032 | A53Q | 11.45% |
| 039.2 | L219F | 17.68% |
| 046 | S177W | 74.01% |
| C05 | A53Q_S177Y_Y288H | 85.70% |
| 019 | A53Q_S177Y | 17.32% |
| 020 | A53Q_Y288H | 83.61% |
| 021 | S177Y_Y288H | 88.73% |
| 032 | A53Q | 11.45% |
| 047.2 | S177Y | 25.03% |
| 052 | Y288H | 86.99% |
| E09 | A53T_M106E_Q161S | 29.97% |
| 025 | A53T_M106E | 15.99% |
| 026 | A53T_Q161S | 32.84% |
| 027 | M106E_Q161S | 39.28% |
| 033 | A53T | 8.75% |
| 040 | M106E | 29.24% |
| 041 | Q161S | 51.78% |
| D04 | A53T_D166E_Q295W | 43.98% |
| 016 | A53T_D166E | 5.02% |
| 017 | A53T_Q295W | 70.34% |
| 018 | D166E_Q295W | 63.59% |
| 033 | A53T | 8.75% |
| 034 | D166E | 13.49% |
| 043 | Q295W | 78.32% |
| H11 | A108G_Q161S_G205M | 47.09% |
| 010 | A108G_Q161S | 42.42% |
| 011 | A108G_G205M | 17.79% |
| 012 | Q161S_G205M | 38.12% |
| 031 | A108G | 18.18% |
| 036 | G205M | 14.04% |
| 041 | Q161S | 51.78% |
| A04 | L219F_V294N_Q295A | 16.74% |
| 004 | L219F_V294N | 13.81% |
| 005.1 | L219F_Q295A | 20.37% |
| 006 | V294N_Q295A | 14.19% |
| 039.2 | L219F | 17.68% |
| 042 | Q295A | 24.51% |
| 050 | V294N | 14.42% |
| G05 | A53T_K118N_S214F | 30.01% |
| 028 | A53T_K118N | 6.24% |
| 029.1 | A53T_S214F | 31.46% |
| 030 | K118N_S214F | 44.77% |
| 033 | A53T | 8.75% |
| 037 | K118N | 17.50% |
| 048 | S214F | 51.33% |
| F09 | Q38G_D166E_Q295A | 37.37% |
| 001 | Q38G_D166E | 14.60% |
| 002 | Q38G_Q295A | 18.61% |
| 003 | D166E_Q295A | 17.65% |
| 034 | D166E | 13.49% |
| 042 | Q295A | 24.51% |
| 044 | Q38G | 17.66% |
| D11 | F123H_L174V_S177E | 33.76% |
| 013 | F123H_L174V | 14.04% |
| 014 | F123H_S177E | 32.66% |
| 015 | L174V_S177E | 86.04% |
| 035 | F123H | 12.63% |
| 045 | S177E | 88.33% |
| 038 | L174V | 19.90% |
| G12 | A17T_Q161W_A232S | 89.66% |
| q423-1 | A17T | 13.71% |
| EE09 | Q161W | 4.21% |
| 424-1 | A232S | 80.92% |
| C06 | Q161A_M162F_Q295A | 49.09% |
| DD01 | Q161A | 26.80% |
| 431-1 | M162F | 39.68% |
| 042.3 | Q295A | 23.80% |
| F08 | A53T_N173D_S214R | 61.02% |
| 033 | A53T | 8.75% |
| 427-4 | N173D | 16.18% |
| BB05 | S214R | 100.00% |

This analysis provided important insights into which positions on ORF2, when mutated, are likely to give rise to significant effects on the enzymatic activity of ORF2 in the reaction using DVA as substrate and GPP as donor. Based on this analysis, the following amino acid sites were selected for targeted amino acid site saturation mutagenesis—V49, Q161, S177, Y288, M106, Q295, S214, M162 and A232.

Figure 40A:
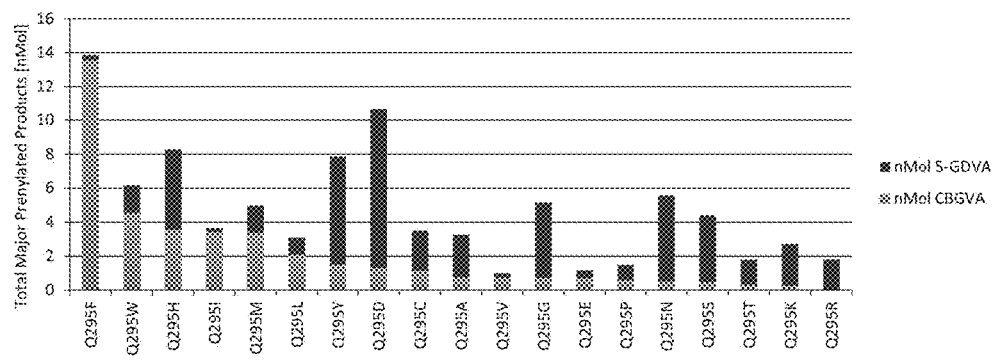
FIG. 40 shows the total amount of prenylated products (FIG. 40A); CBGVA production potential (FIG. 40B); and %5-GDVA production potential (FIG. 40C) of site saturated mutants of Q295.
Figure 40B:
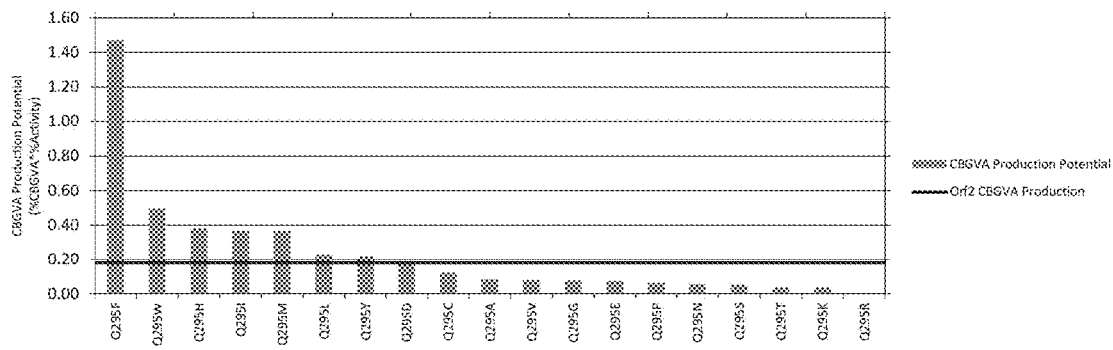
Figure 40C:
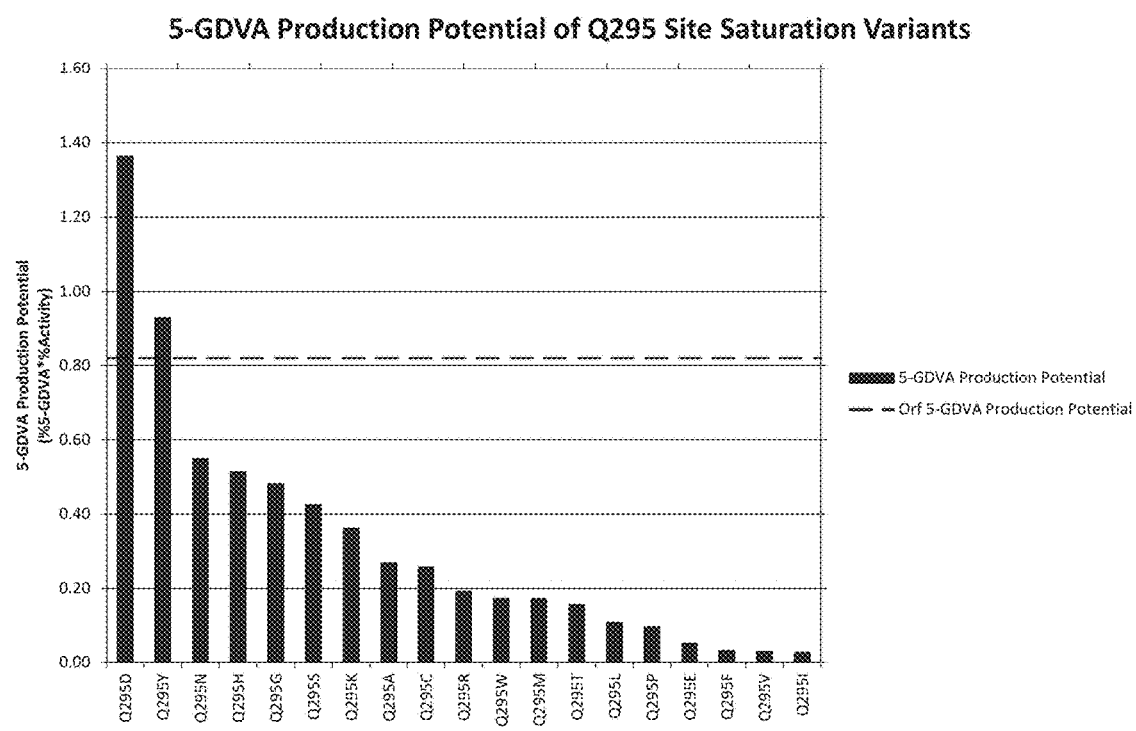
Figure 41A:
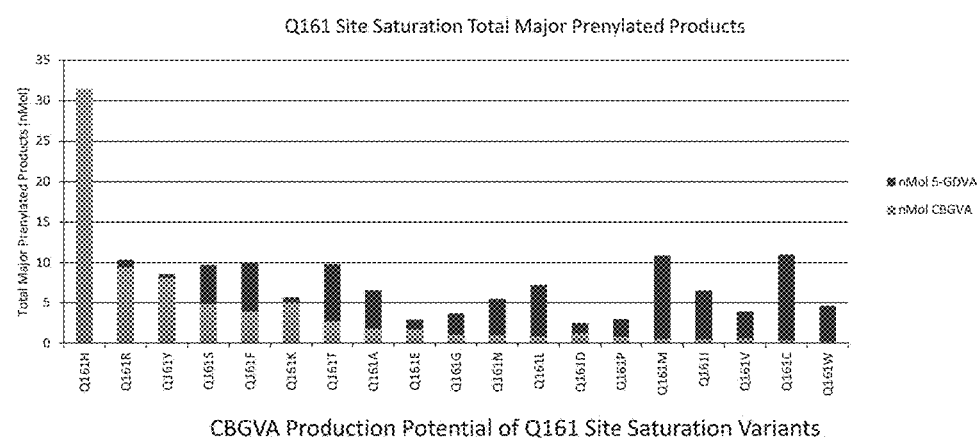
FIG. 41 shows the total amount of prenylated products (FIG. 41A); CBGVA production potential (FIG. 41B); and %5-GDVA production potential (FIG. 41C) of site saturated mutants of Q161.
Figure 41B:
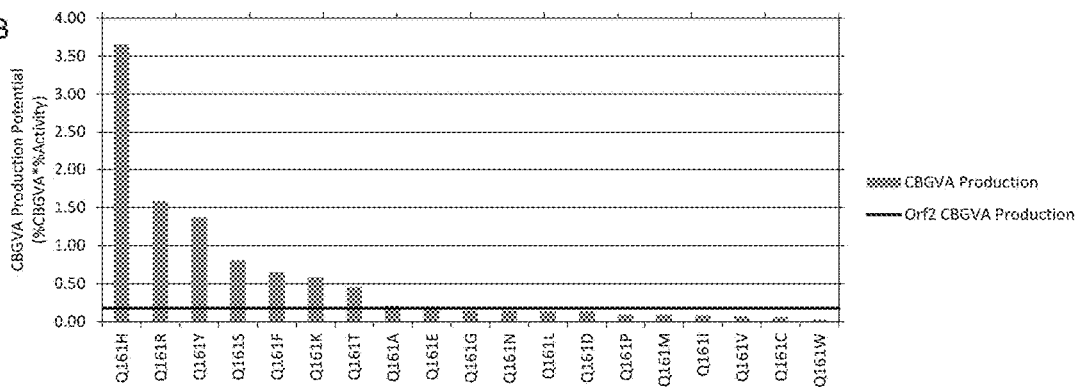
Figure 41C:
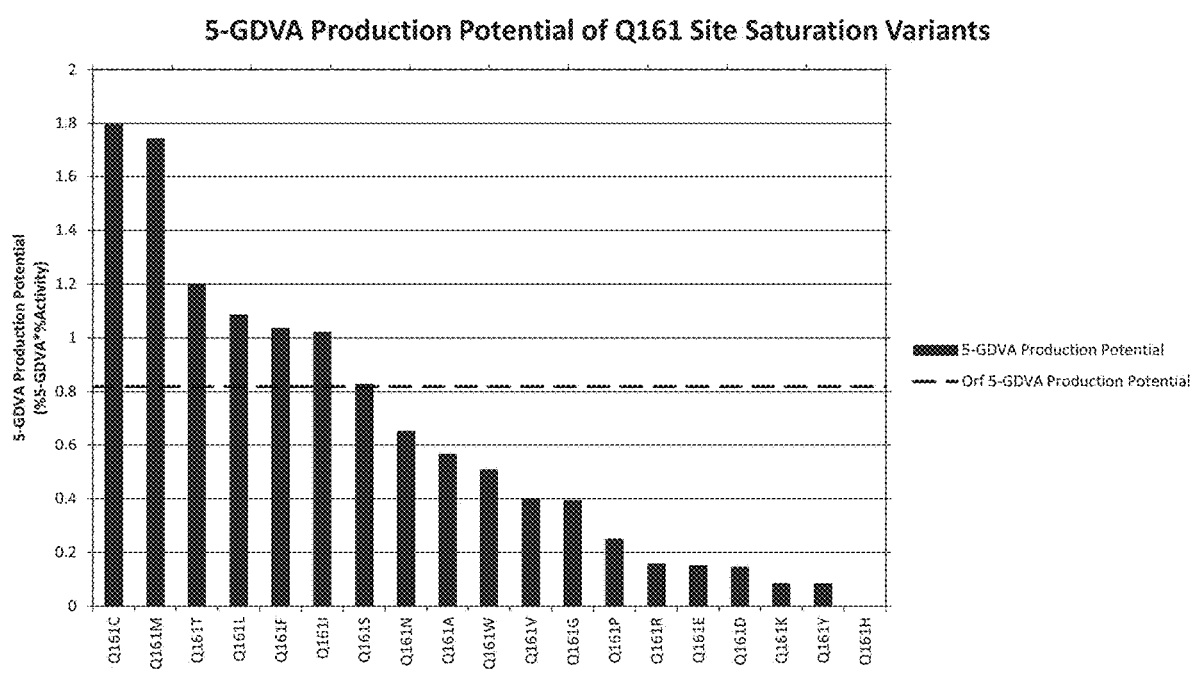
Figure 42A:
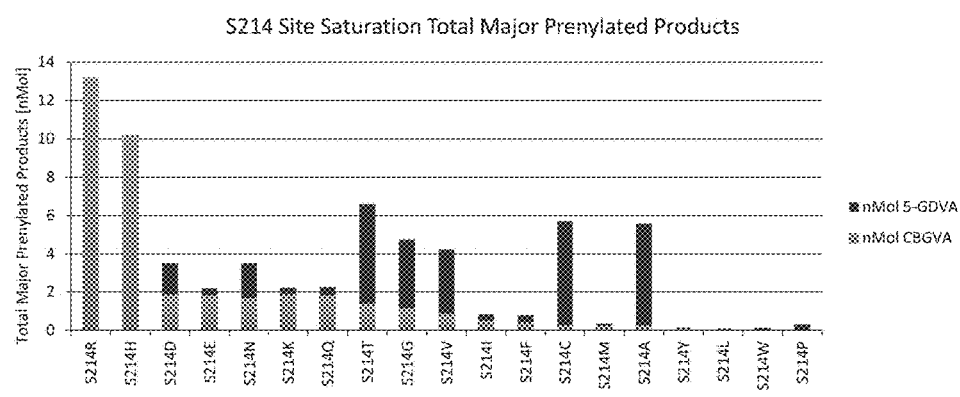
FIG. 42 shows the total amount of prenylated products (FIG. 42A); CBGVA production potential (FIG. 42B); and %5-GDVA production potential (FIG. 42C) of site saturated mutants of S214.
Figure 42B:
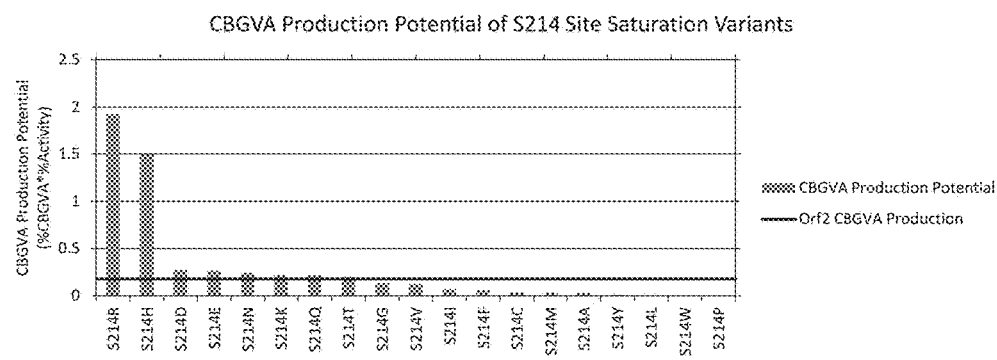
Figure 42C:
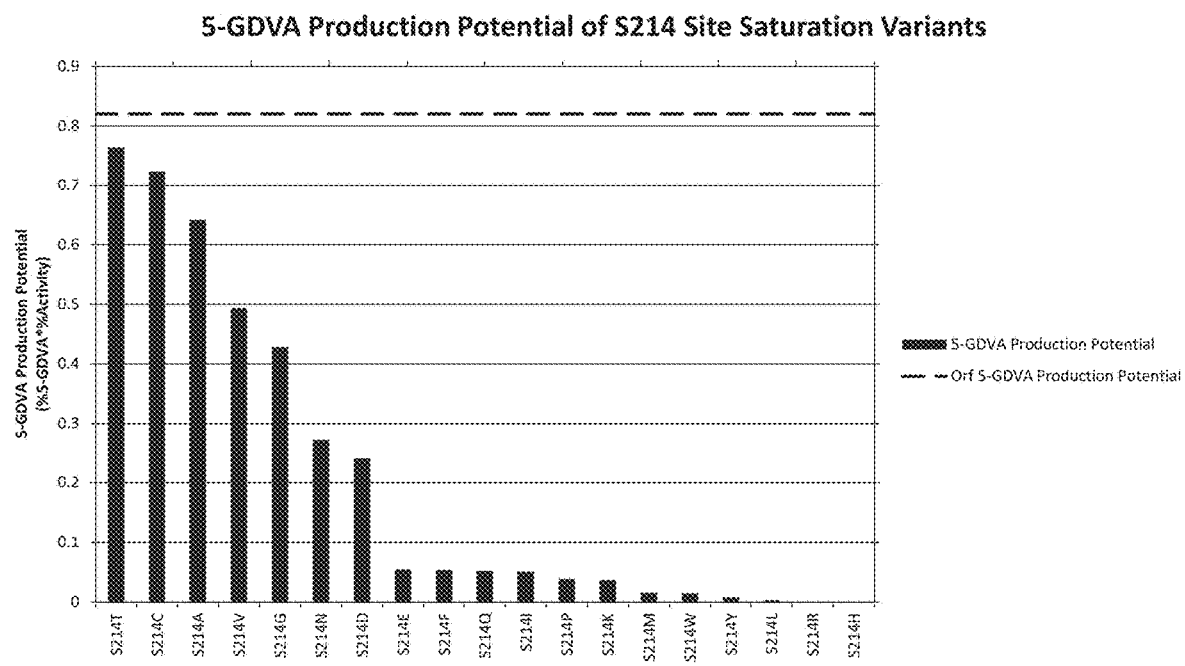
Figure 98A:
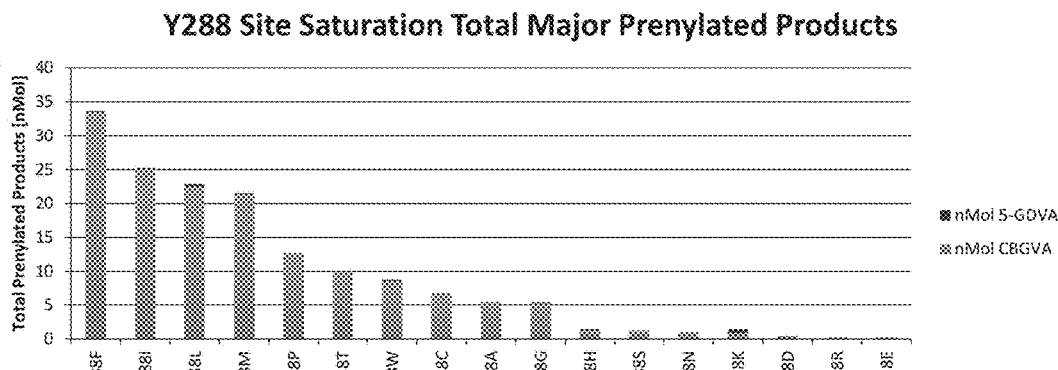
FIG. 98. Analysis of enzymatic activity of site-saturated ORF2 mutants of Y288 using DVA as substrate and GPP as donor~including total prenylated products (FIG. 98A); CBGVA production potential (FIG. 98B); and 5-GDVA production potential (FIG. 98C).
Figure 98B:
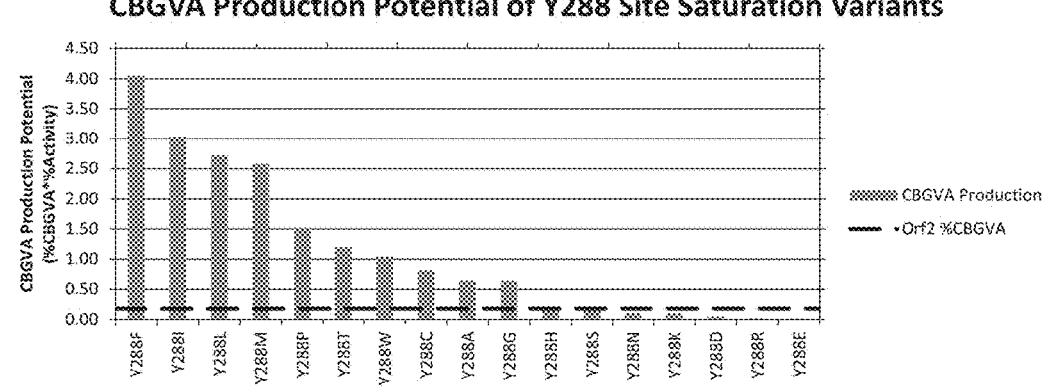
Figure 98C:
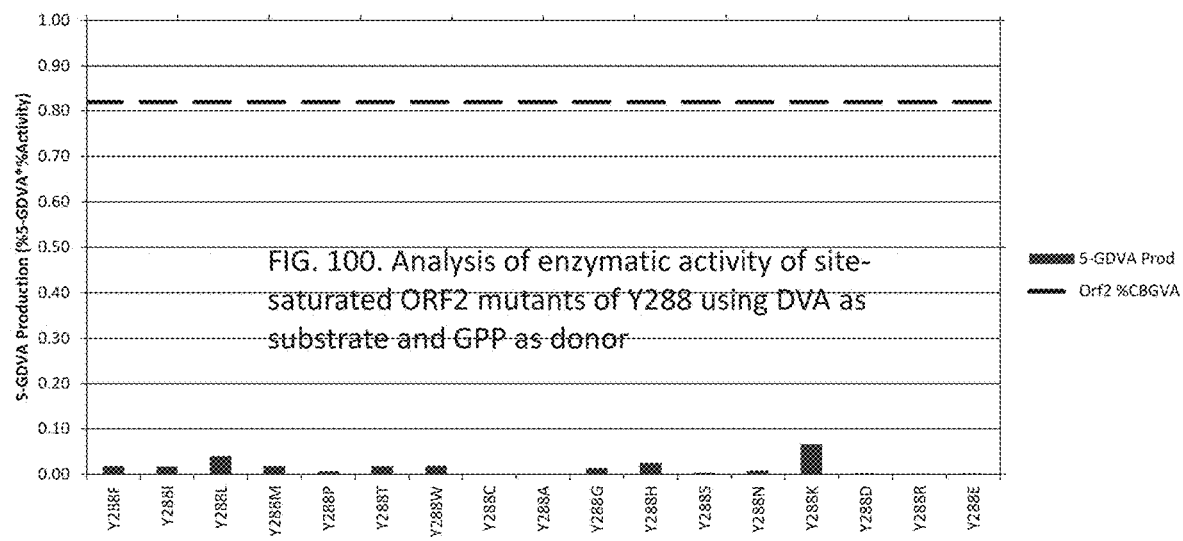
Figure 99A:
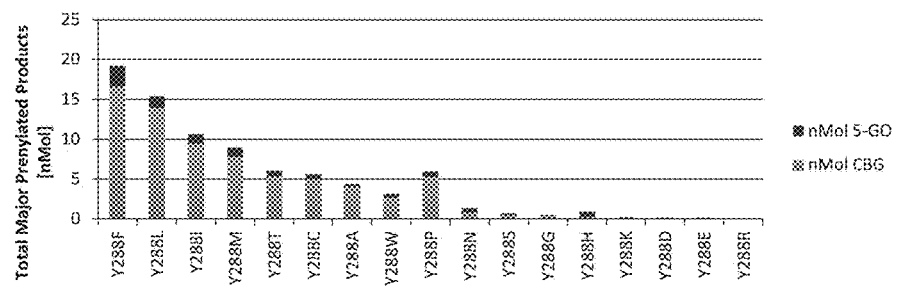
FIG. 99. Analysis of enzymatic activity of site-saturated ORF2 mutants of Y288 using O as substrate and GPP as donor~including total prenylated products (FIG. 99A); CBG production potential (FIG. 99B); and 5-GO production potential (FIG. 99C).
Figure 99B:
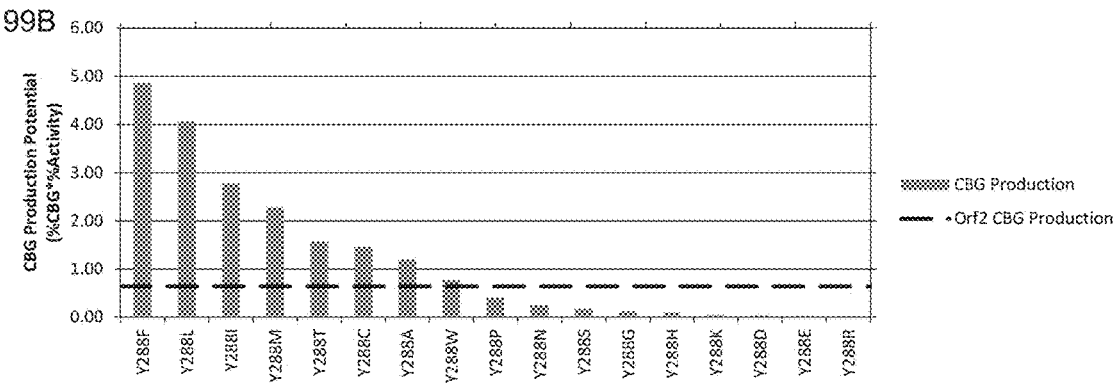
Figure 99C:
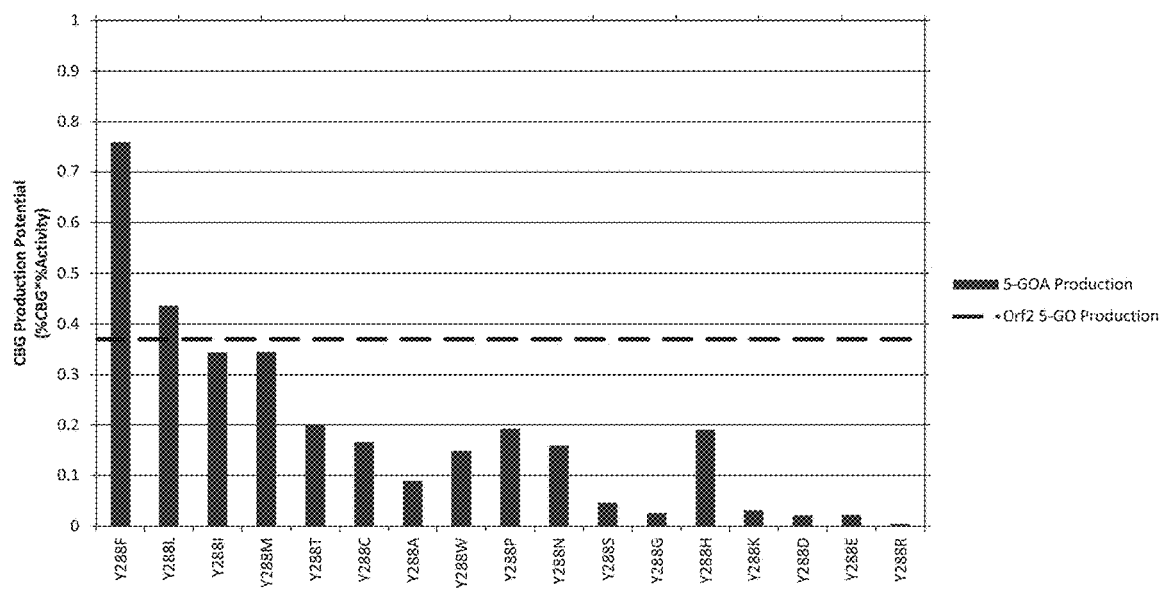
Figure 100A:
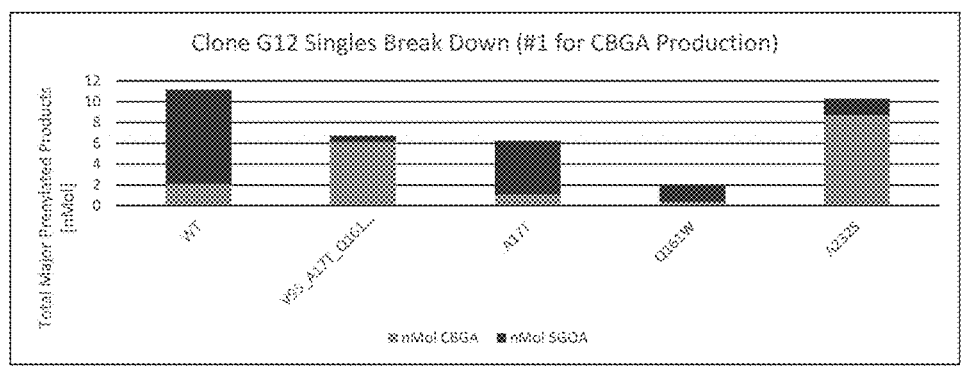
FIG. 100: Analysis of ORF-2 enzymatic function of single mutants derived from the breakdown of ORF-2 triple mutant clone G12—including total prenylated products (FIG. 100A); and % CBGA produced (FIG. 100B).
Figure 100B:
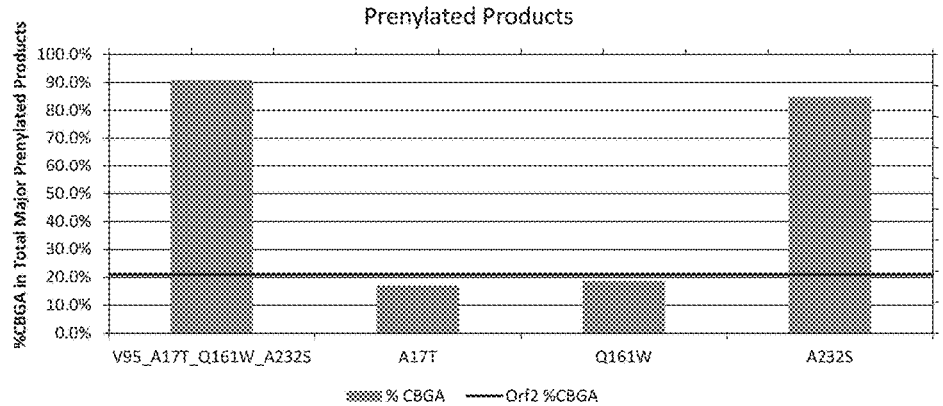
Figure 101A:
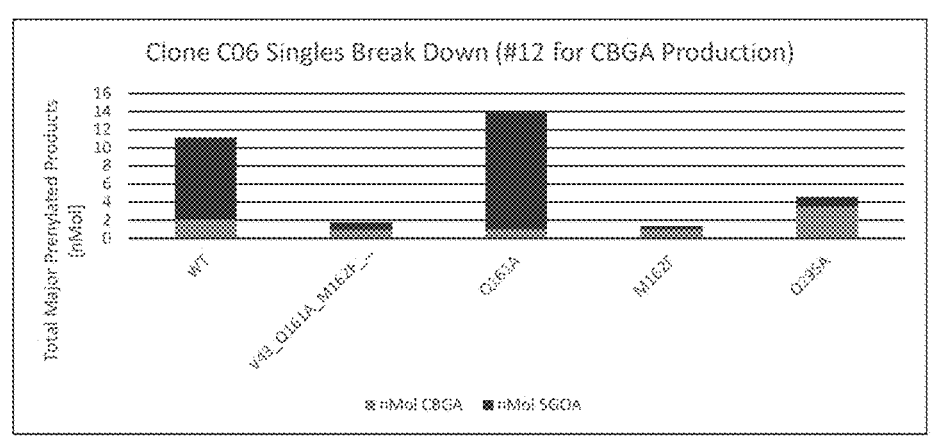
FIG. 101: Analysis of ORF-2 enzymatic function of single mutants derived from the breakdown of ORF-2 triple mutant clone C06—including total prenylated products (FIG. 101A); and % CBGA produced (FIG. 101B).
Figure 101B:
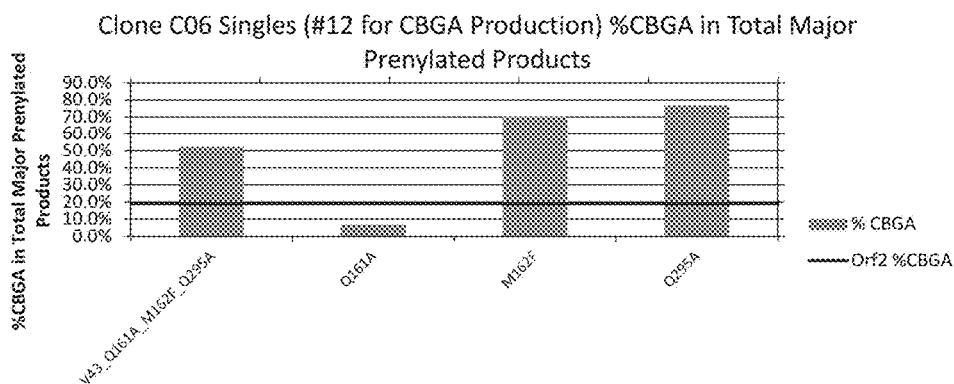
Figure 102A:
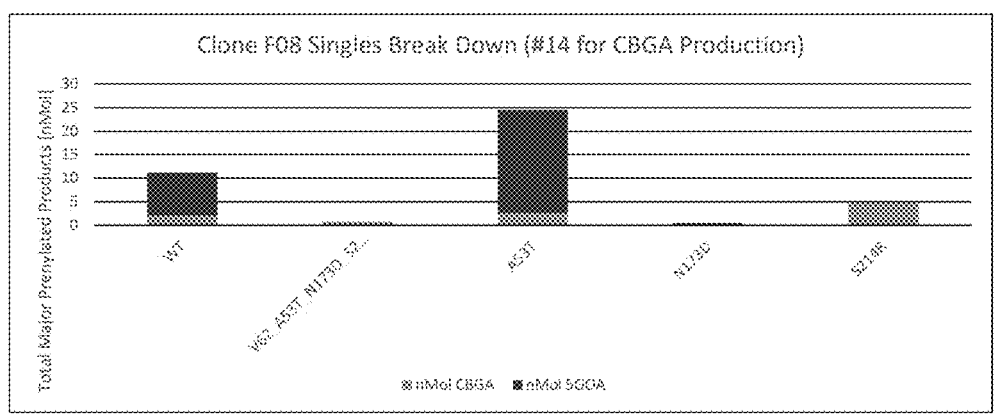
FIG. 102: Analysis of ORF-2 enzymatic function of single mutants derived from the breakdown of ORF-2 triple mutant clone F08—including total prenylated products (FIG. 102A); and % CBGA produced (FIG. 102B).
Figure 102B:
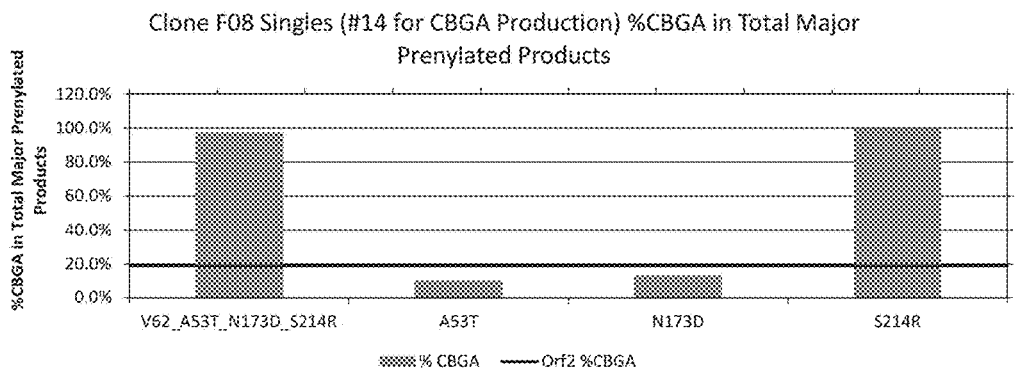
Figure 104A:
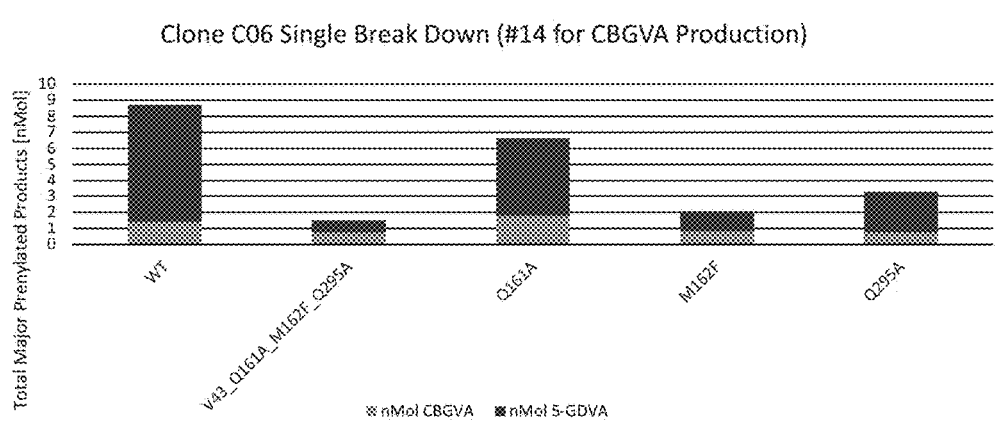
FIG. 104: Analysis of ORF-2 enzymatic function of single mutants derived from the breakdown of ORF-2 triple mutant clone C06—including total prenylated products (FIG. 104A); and % CBGVA produced (FIG. 104B).
Figure 104B:
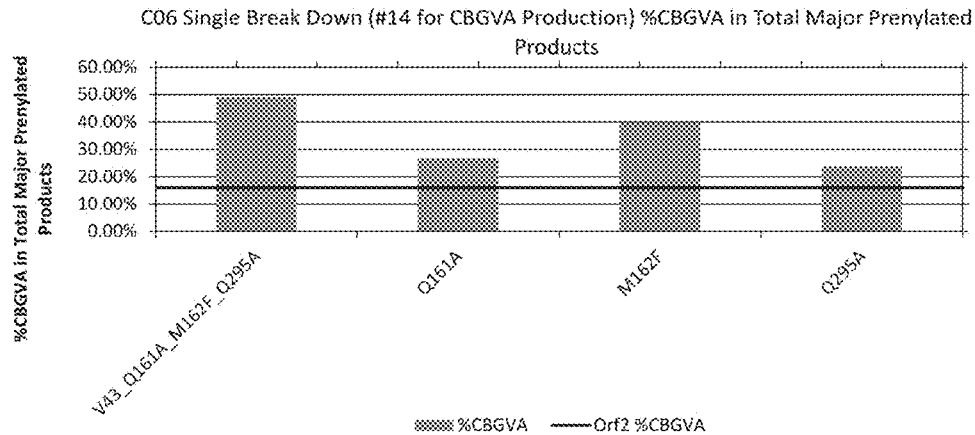
Figure 105A:
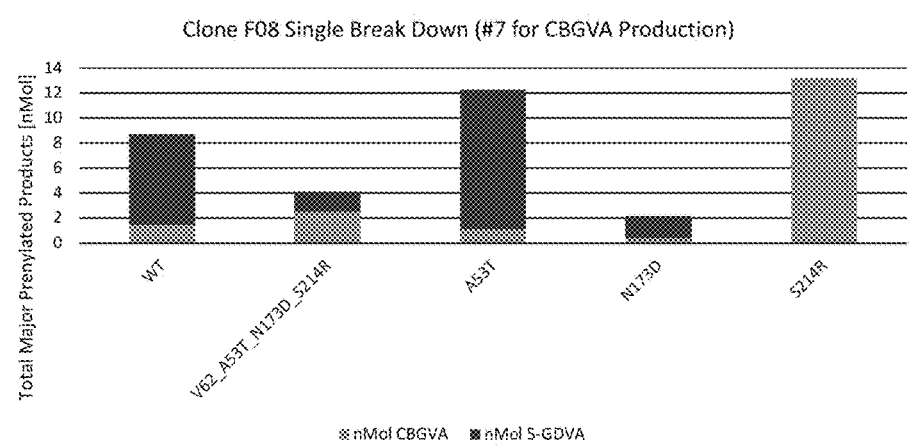
FIG. 105: Analysis of ORF-2 enzymatic function of single mutants derived from the breakdown of ORF-2 triple mutant clone F08—including total prenylated products (FIG. 105A); and % CBGVA produced (FIG. 105B).
Figure 105B:
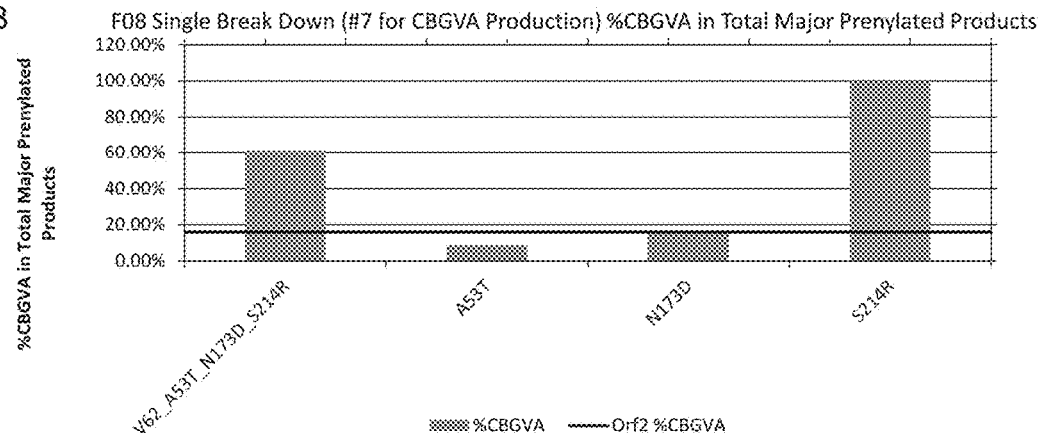
Figure 106A:
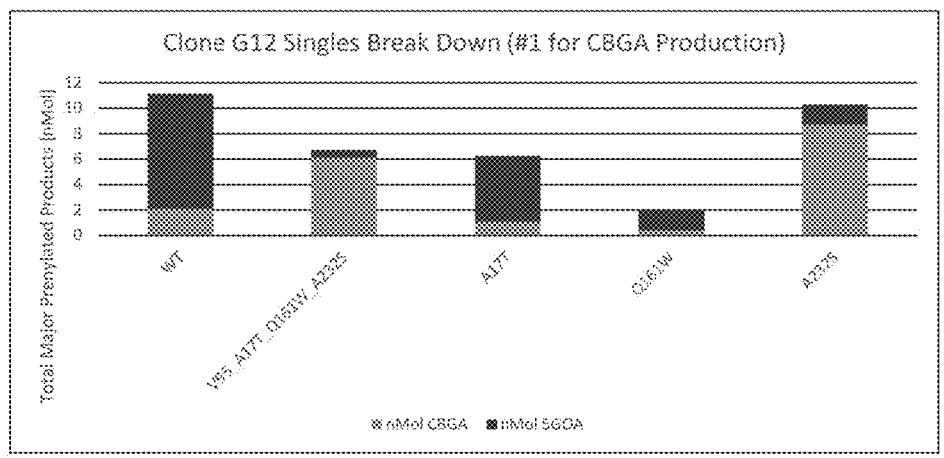
FIG. 106: Analysis of ORF-2 enzymatic function of single mutants derived from the breakdown of ORF-2 triple mutant clone G12—including total prenylated products (FIG. 106A); and % CBG produced (FIG. 106B).
Figure 106B:
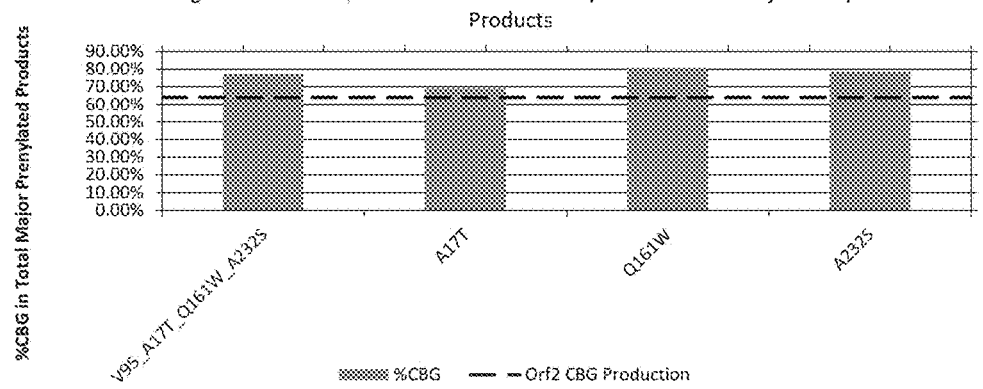
Figure 107A:
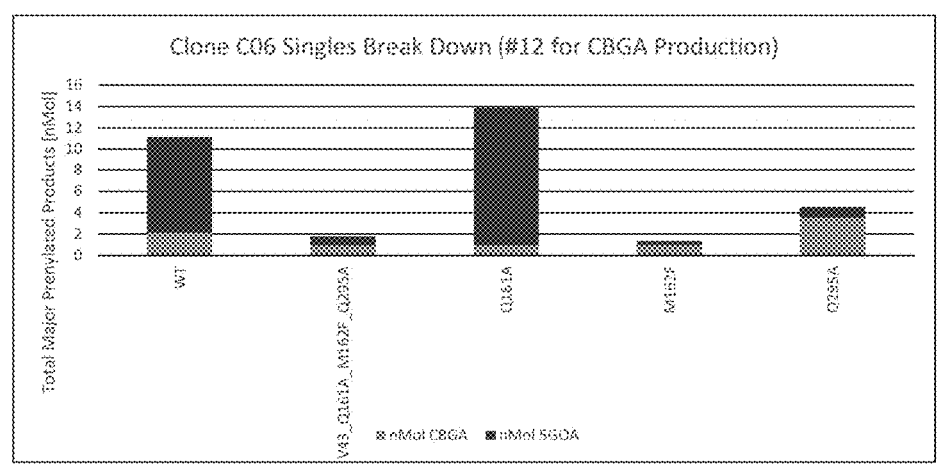
FIG. 107: Analysis of ORF-2 enzymatic function of single mutants derived from the breakdown of ORF-2 triple mutant clone C06—including total prenylated products (FIG. 107A); and % CBG produced (FIG. 107B).
Figure 107B:
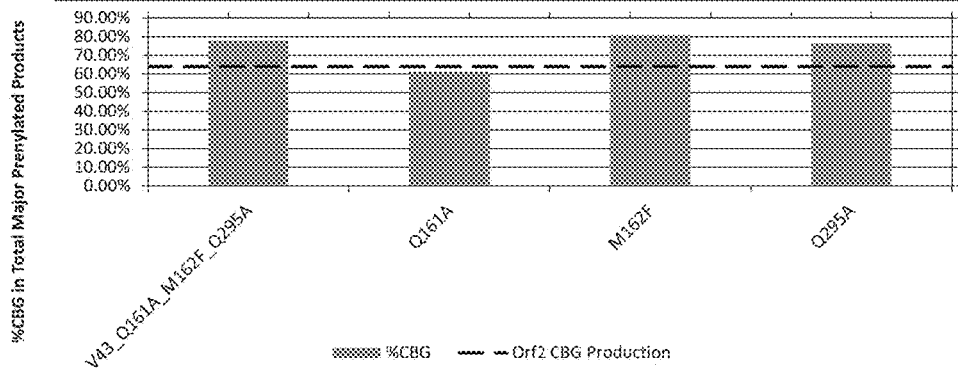
Figure 108:
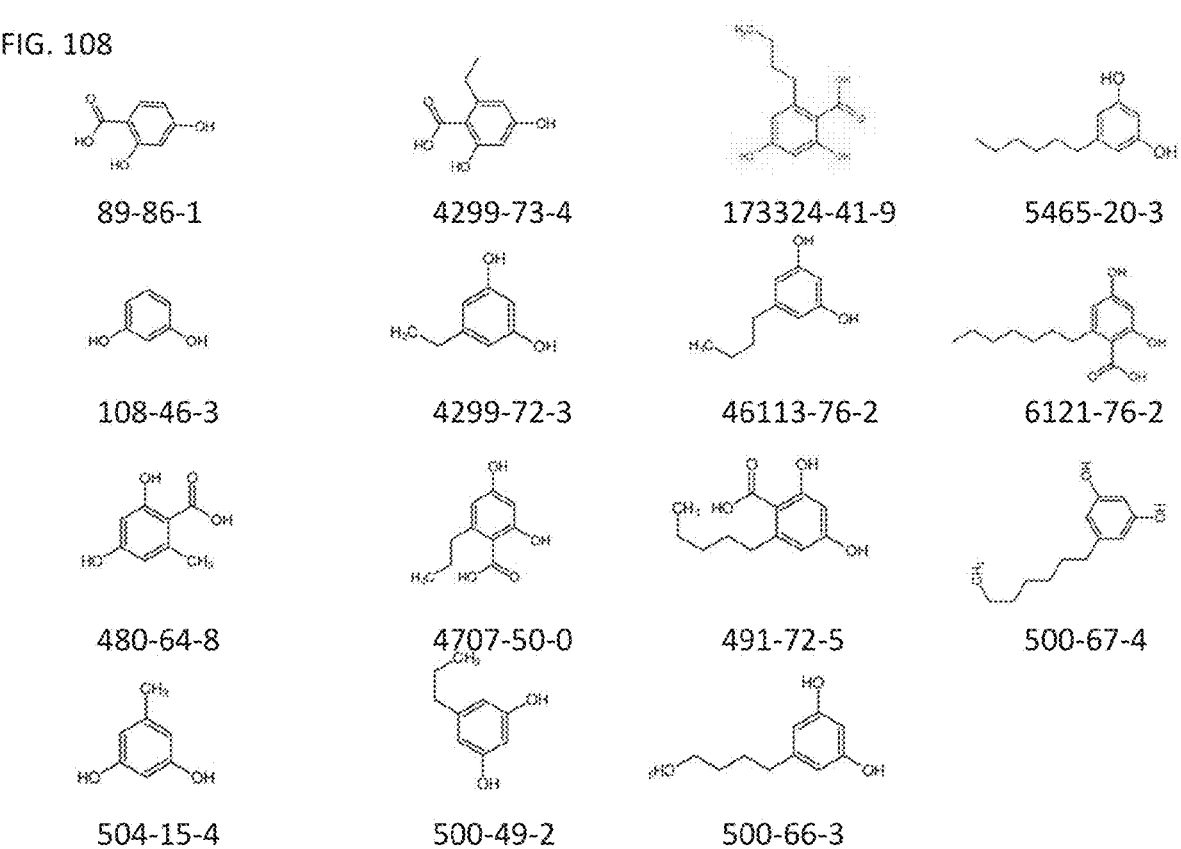
FIG. 108: Examples of benzoic acids and benzenediols applicable for prenylation by Orf2 mutants
Figure 109:
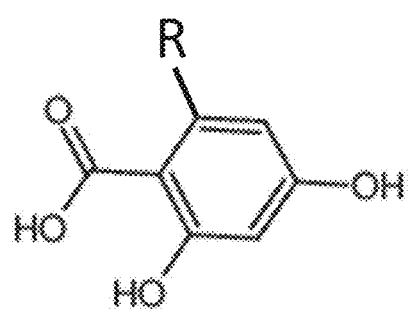
FIG. 109: Structures of benzoic acids and benzenediols applicable for prenylation by Orf2 mutants
Figure 109:
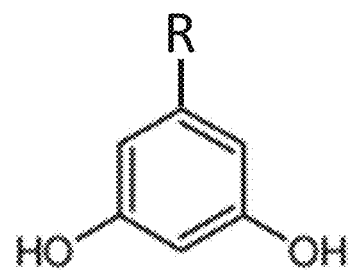
Figure 110:
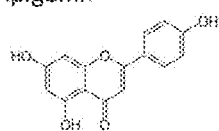
FIG. 110: Examples of other substrate molecules applicable for prenylation with Orf2 variants
Figure 110:
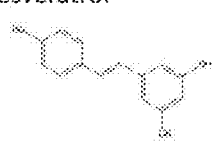
Figure 110:
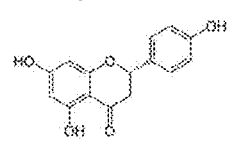
Figure 110:
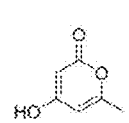
Figure 110:
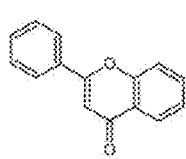
Figure 110:
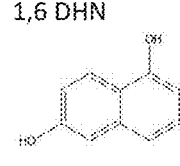

Site saturated mutants of Q295, Q161, S214 and Y288, described in Example 1, were analyzed to determine the amount of total prenylated products they produce; their respective CBGVA production potential; and 5-GDVA production potential using DVA as substrate and GPP as donor. These results are depicted in FIG. 40 (Q295), FIG. 41 (Q161), FIG. 42 (S214) and FIG. 98 (Y288); and in Tables 14-17.

TABLE 14

Q295 site saturated mutants

| Mutations | nMol CBGVA | nMol 5-GDVA | Total Products | % CBGVA | % Activity | CBGVA Production Potential | % 5-GDVA | 5-GDVA Production Potential |
|---|---|---|---|---|---|---|---|---|
| Q295D | 1.29140226 | 9.345758355 | 10.63716061 | 12.14% | 155.20% | 0.19 | 87.86% | 1.36 |
| Q295Y | 1.501276892 | 6.363975677 | 7.865252569 | 19.09% | 114.76% | 0.22 | 80.91% | 0.93 |
| Q295N | 0.511492029 | 5.062710105 | 5.574202134 | 9.18% | 60.35% | 0.06 | 90.82% | 0.55 |
| Q295H | 3.540705773 | 4.739840815 | 8.280546588 | 42.76% | 89.65% | 0.38 | 57.24% | 0.51 |
| Q295G | 0.703722334 | 4.449401819 | 5.153124153 | 13.66% | 55.79% | 0.08 | 86.34% | 0.48 |
| Q295S | 0.480420987 | 3.918108562 | 4.39852955 | 10.92% | 47.62% | 0.05 | 89.08% | 0.42 |
| Q295K | 0.249922613 | 2.476591853 | 2.726514465 | 9.17% | 39.78% | 0.04 | 90.83% | 0.36 |
| Q295A | 0.775344374 | 2.481832114 | 3.257176488 | 23.80% | 35.27% | 0.08 | 76.20% | 0.27 |
| Q295C | 1.126799257 | 2.37638422 | 3.503183477 | 32.17% | 37.93% | 0.12 | 67.83% | 0.26 |
| Q295R | 0.038925863 | 1.778425944 | 1.817351807 | 2.14% | 19.68% | 0.00 | 97.86% | 0.19 |
| Q295W | 4.568410463 | 1.598897568 | 6.167308031 | 74.07% | 66.77% | 0.49 | 25.93% | 0.17 |
| Q295M | 3.386047052 | 1.594695472 | 4.980742523 | 67.98% | 53.93% | 0.37 | 32.02% | 0.17 |
| Q295T | 0.343174431 | 1.441393118 | 1.78456755 | 19.23% | 19.32% | 0.04 | 80.77% | 0.16 |
| Q295L | 2.095728215 | 0.998467471 | 3.094195686 | 67.73% | 33.50% | 0.23 | 32.27% | 0.11 |
| Q295P | 0.579322086 | 0.893439786 | 1.472761873 | 39.34% | 15.95% | 0.06 | 60.66% | 0.10 |
| Q295E | 0.68298251 | 0.480324303 | 1.163306813 | 58.71% | 12.60% | 0.07 | 41.29% | 0.05 |
| Q295F | 13.57351803 | 0.283839233 | 13.85735726 | 97.95% | 150.03% | 1.47 | 2.05% | 0.03 |
| Q295V | 0.736921529 | 0.261963615 | 0.998885144 | 73.77% | 10.81% | 0.08 | 26.23% | 0.03 |
| Q295I | 3.401176289 | 0.248071979 | 3.649248268 | 93.20% | 39.51% | 0.37 | 6.80% | 0.03 |

TABLE 15

Q161 site saturated mutants

| Mutations | nMol CBGVA | nMol 5-GDVA | Total Products | % CBGVA | % Activity | CBGVA Production potential | % 5-GDVA | 5-GDVA Production Potential |
|---|---|---|---|---|---|---|---|---|
| Q161C | 0.342207089 | 10.68046767 | 11.02267476 | 3.10% | 185.25% | 0.06 | 96.90% | 1.79495767 |
| Q161M | 0.526466491 | 10.36728792 | 10.89375441 | 4.83% | 183.08% | 0.09 | 95.17% | 1.742324731 |
| Q161T | 2.700278595 | 7.140523037 | 9.840801632 | 27.44% | 165.38% | 0.45 | 72.56% | 1.200035147 |
| Q161L | 0.836673889 | 6.451057939 | 7.287731829 | 11.48% | 122.48% | 0.14 | 88.52% | 1.084163754 |
| Q161F | 3.890728989 | 6.157108958 | 10.04783795 | 38.72% | 168.86% | 0.65 | 61.28% | 1.034762736 |
| Q161I | 0.501315586 | 6.070026696 | 6.571342281 | 7.63% | 110.44% | 0.08 | 92.37% | 1.020127705 |
| Q161S | 4.812335552 | 4.916106387 | 9.728441939 | 49.47% | 163.50% | 0.81 | 50.53% | 0.826200045 |
| Q161N | 0.992802972 | 4.474688551 | 5.467491522 | 18.16% | 79.77% | 0.14 | 81.84% | 0.652878827 |
| Q161A | 1.775886086 | 4.850479533 | 6.626365619 | 26.80% | 77.10% | 0.21 | 73.20% | 0.56439113 |
| Q161W | 0.193778053 | 4.411879573 | 4.605657626 | 4.21% | 52.93% | 0.02 | 95.79% | 0.507033637 |
| Q161V | 0.594335242 | 3.318741349 | 3.913076591 | 15.19% | 47.18% | 0.07 | 84.81% | 0.400147091 |
| Q161G | 0.999961306 | 2.683112517 | 3.683073824 | 27.15% | 53.74% | 0.15 | 72.85% | 0.391479168 |
| Q161P | 0.78366352 | 2.170333202 | 2.953996721 | 26.53% | 33.95% | 0.09 | 73.47% | 0.249424745 |
| Q161R | 9.435304132 | 0.931753016 | 10.36705715 | 91.01% | 174.23% | 1.59 | 8.99% | 0.156590261 |
| Q161E | 1.672070887 | 1.24184299 | 2.913913877 | 57.38% | 35.13% | 0.20 | 42.62% | 0.149731422 |
| Q161D | 1.211654543 | 1.262013051 | 2.473667594 | 48.98% | 28.43% | 0.14 | 51.02% | 0.145036386 |
| Q161K | 5.035404736 | 0.710945224 | 5.746349961 | 87.63% | 66.86% | 0.59 | 12.37% | 0.082724023 |
| Q161Y | 8.142121963 | 0.489148705 | 8.631270667 | 94.33% | 145.06% | 1.37 | 5.67% | 0.082206252 |
| Q161H | 31.43685188 | 0 | 31.43685188 | 100.00% | 365.79% | 3.66 | 0.00% | 0 |

TABLE 16

S214 site saturated mutants

| Mutations | nMol CBGVA | nMol 5-GDVA | Total Products | % CBGVA | % Activity | CBGVA Production Potential | % 5-GDVA | 5-GDVA Production Potential |
|---|---|---|---|---|---|---|---|---|
| S214T | 1.3722334 | 5.235391536 | 6.607624937 | 20.77% | 0.964084621 | 0.200215528 | 79.23% | 0.763869093 |
| S214C | 0.265206624 | 5.436770813 | 5.701977437 | 4.65% | 0.758613666 | 0.03528414 | 95.35% | 0.723329526 |
| S214A | 0.24686581 | 5.326280403 | 5.573146214 | 4.43% | 0.671055324 | 0.029724793 | 95.57% | 0.641330531 |
| S214V | 0.854859929 | 3.382539055 | 4.237398984 | 20.17% | 0.618567125 | 0.124728222 | 79.83% | 0.493528902 |
| S214G | 1.124864572 | 3.627545976 | 4.752410548 | 23.67% | 0.561118545 | 0.132813099 | 76.33% | 0.428305446 |
| S214N | 1.656013001 | 1.869166502 | 3.525179503 | 46.98% | 0.514340838 | 0.241620353 | 53.02% | 0.272720485 |
| S214D | 1.865500696 | 1.657010085 | 3.522510782 | 52.96% | 0.513951458 | 0.272185626 | 47.04% | 0.241765832 |
| S214E | 1.805254605 | 0.375568519 | 2.180823123 | 82.78% | 0.318192702 | 0.263395428 | 17.22% | 0.054797274 |
| S214F | 0.415609039 | 0.364890251 | 0.78049929 | 53.25% | 0.113878643 | 0.060639381 | 46.75% | 0.053239263 |
| S214Q | 1.803900325 | 0.430838442 | 2.234738767 | 80.72% | 0.269082003 | 0.217205304 | 19.28% | 0.051876699 |
| S214I | 0.482239591 | 0.348279612 | 0.830519204 | 58.06% | 0.121176792 | 0.070361102 | 41.94% | 0.05081569 |
| S214P | 0.015206624 | 0.291032233 | 0.306238857 | 4.97% | 0.040743231 | 0.00202315 | 95.03% | 0.038720081 |
| S214K | 1.887556106 | 0.314489816 | 2.202045922 | 85.72% | 0.25622522 | 0.219631877 | 14.28% | 0.036593343 |

TABLE 16-continued

S214 site saturated mutants

| Mutations | nMol CBGVA | nMol 5-GDVA | Total Products | % CBGVA | % Activity | CBGVA Production Potential | % 5-GDVA | 5-GDVA Production Potential |
|---|---|---|---|---|---|---|---|---|
| S214M | 0.227093329 | 0.106115286 | 0.333208615 | 68.15% | 0.048616758 | 0.033134021 | 31.85% | 0.015482736 |
| S214W | 0.016483516 | 0.099070595 | 0.115554112 | 14.26% | 0.016859907 | 0.002405025 | 85.74% | 0.014454882 |
| S214Y | 0.077619564 | 0.052995847 | 0.130615411 | 59.43% | 0.019057424 | 0.011325072 | 40.57% | 0.007732352 |
| S214L | 0.054171181 | 0.021628436 | 0.075799617 | 71.47% | 0.011059533 | 0.007903839 | 28.53% | 0.003155694 |
| S214R | 13.19528711 | 0 | 13.19528711 | 100.00% | 1.925256578 | 1.925256578 | 0.00% | 0 |
| S214H | 10.22125058 | 0 | 10.22125058 | 100.00% | 1.491330181 | 1.491330181 | 0.00% | 0 |

TABLE 17

Y288 site saturated mutants

| Mutations | nMol CBGVA | nMol 5-GDVA | Total Products | % CBGVA | % Activity | CBGVA Production | % 5-GDVA | 5-GDVA Prod |
|---|---|---|---|---|---|---|---|---|
| Y288F | 33.52313883 | 0.145837453 | 33.66897629 | 99.57% | 405.95% | 4.04 | 0.43% | 0.02 |
| Y288I | 25.12084043 | 0.138421989 | 25.25926242 | 99.45% | 304.56% | 3.03 | 0.55% | 0.02 |
| Y288L | 22.54945055 | 0.325439984 | 22.87489053 | 98.58% | 275.81% | 2.72 | 1.42% | 0.04 |
| Y288M | 21.39599133 | 0.146035199 | 21.54202653 | 99.32% | 259.74% | 2.58 | 0.68% | 0.02 |
| Y288P | 12.60462777 | 0.052674511 | 12.65730228 | 99.58% | 152.61% | 1.52 | 0.42% | 0.01 |
| Y288T | 9.939676521 | 0.141487048 | 10.08116357 | 98.60% | 121.55% | 1.20 | 1.40% | 0.02 |
| Y288W | 8.629972141 | 0.152264188 | 8.782236329 | 98.27% | 105.89% | 1.04 | 1.73% | 0.02 |
| Y288C | 6.701865036 | 0 | 6.701865036 | 100.00% | 80.81% | 0.81 | 0.00% | 0.00 |
| Y288A | 5.34870763 | 0 | 5.34870763 | 100.00% | 64.49% | 0.64 | 0.00% | 0.00 |
| Y288G | 5.26087293 | 0.108587107 | 5.369460037 | 97.98% | 64.74% | 0.63 | 2.02% | 0.01 |
| Y288H | 1.234058195 | 0.204419616 | 1.438477812 | 85.79% | 17.34% | 0.15 | 14.21% | 0.02 |
| Y288S | 1.190102151 | 0.026522642 | 1.216624793 | 97.82% | 14.67% | 0.14 | 2.18% | 0.00 |
| Y288N | 0.893437548 | 0.060806802 | 0.954244351 | 93.63% | 11.49% | 0.11 | 6.37% | 0.01 |
| Y288K | 0.856485064 | 0.547137631 | 1.403622695 | 61.02% | 16.92% | 0.10 | 38.98% | 0.07 |
| Y288D | 0.358651911 | 0.01977457 | 0.378426481 | 94.77% | 4.56% | 0.04 | 5.23% | 0.00 |
| Y288R | 0.156786875 | 0.012878189 | 0.169665064 | 92.41% | 2.05% | 0.02 | 7.59% | 0.00 |
| Y288E | 0.139684259 | 0.017401622 | 0.157085881 | 88.92% | 1.89% | 0.02 | 11.08% | 0.00 |

In a similar manner, site saturated mutants of V49, 5177, and M106 will also be generated. Mutant ORF2 enzymatic function using DVA as substrate and GPP as donor for each of these site saturated mutants will be analyzed as described above.

From the results described above, multiple mutations of Q295, Q16I, Y288 and S214 that have significantly higher CBGVA production potential and/or the total amount of prenylated products, as compared to WT ORF2, were identified. Thus, the ORF2 mutants disclosed herein have unexpectedly superior enzymatic functions, in a reaction using DVA as a substrate and GPP as donor, as compared to WT ORF2.

Figure 43:
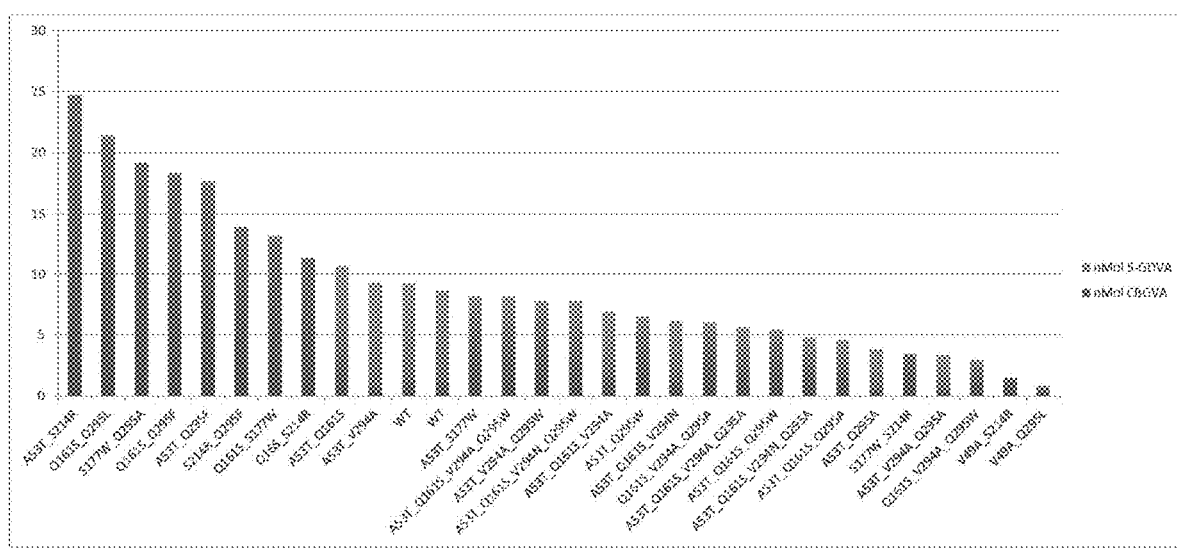
FIG. 43 shows total nMol of prenylated products produced (using DVA as substrate and GPP as donor) by ORF2 stacking mutants.
Figure 44:
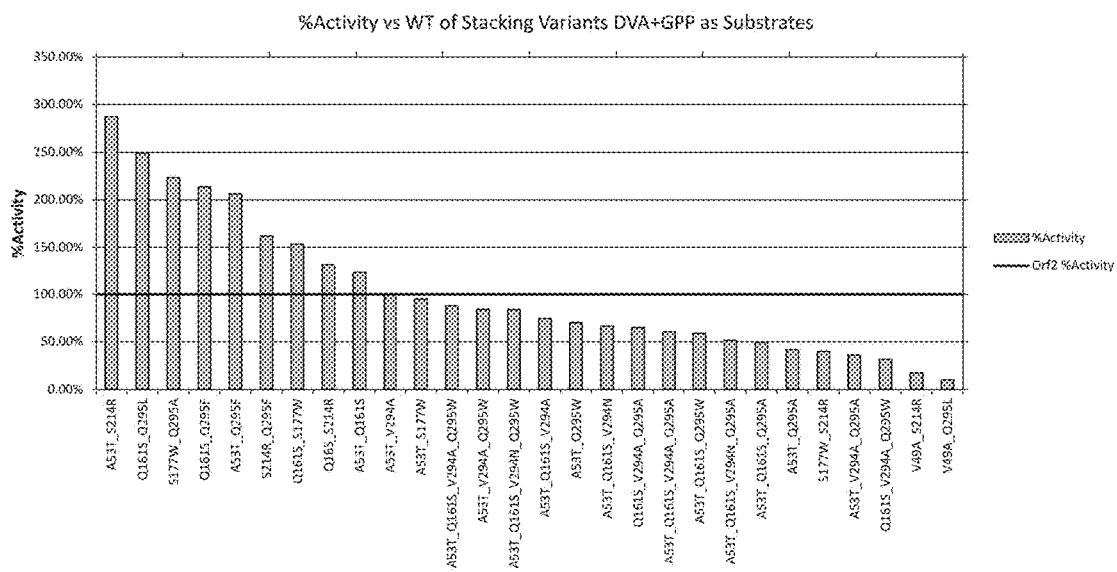
FIG. 44 shows the % enzymatic activity using DVA substrate and GPP as donor of ORF2 stacking mutants.
Figure 45:
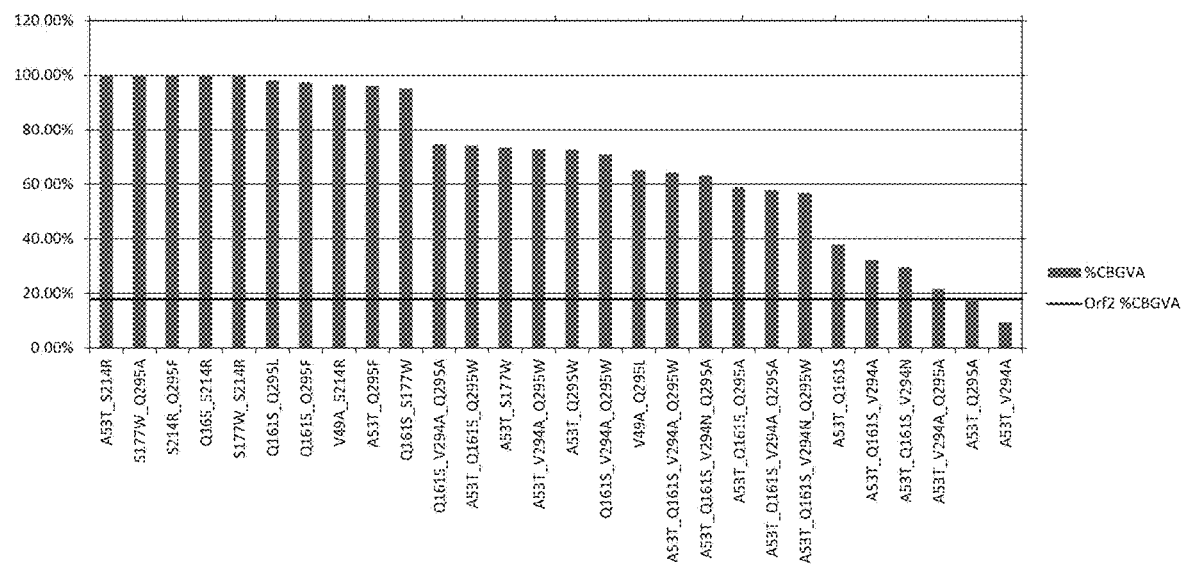
FIG. 45 shows the % CBGVA produced (using DVA as substrate and GPP as donor) by ORF2 stacking mutants
Figure 46:
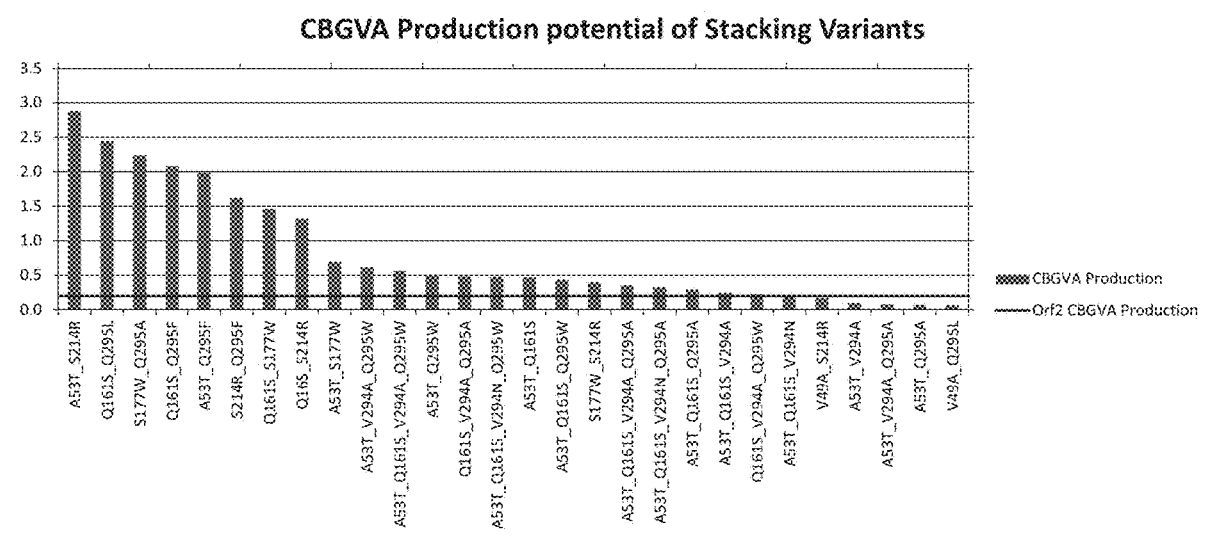

Finally, ORF2 stacking mutants that carry different novel combinations of the mutations that our analysis identified as being important for ORF2's enzymatic activity were analyzed to obtain the total amount of prenylated products produced by each of the stacking mutants (FIG. 43); % enzymatic activity (FIG. 44), % CBGVA produced (FIG. 45), and CBGVA production potential (FIG. 46). Table 18 provides a summary of the enzymatic function, using DVA as substrate and GPP as donor, for each of the stacking mutants.

The analysis of the stacking mutants shows that multiple stacking mutants have significantly higher % enzymatic activity, % CBGVA, and CBGVA production potential, compared to the WT ORF2, thereby indicating that the ORF2 stacking mutants disclosed herein have synergistically enhanced effects compared to the individual single mutants. Thus, the ORF2 stacking mutants disclosed herein have unexpectedly superior enzymatic functions, in a reaction using DVA and GPP, as compared to WT ORF2.

For instance, ORF2 double mutants, A53T-S214R; Q161S-Q295L; Q161S-Q295F; S177W-Q295A; A53T-Q295F; and Q161S-S177W have synergistically enhanced CBGVA production potential and % activity as compared to either of the single mutants. See FIGS. 86-91.

More stacking mutants will be generated as described above, based on the planned breakdown analysis of triple mutants described above, and planned site saturation mutagenesis experiments described above. These stacking mutants will further be analyzed to determine their % enzymatic activity, % CBGVA, %5-GDVA and CBGVA production potential.

TABLE 18

| Mutations | CBGVA (6.39) | 5-GDVA (6.458) | nMol CBGVA | nMol 5-GDVA | Total Products | % CBGVA | % Activity | CBGVA Production |
|---|---|---|---|---|---|---|---|---|
| A53T_S214R | 63.8414 | | 24.70260022 | 0 | 24.70260022 | 100.00% | 287.43% | 2.9 |
| Q161S_Q295L | 54.3225 | 1.5682 | 21.01938554 | 0.387631007 | 21.40701655 | 98.19% | 249.09% | 2.4 |
| S177W_Q295A | 49.6105 | | 19.19613837 | 0 | 19.19613837 | 100.00% | 223.36% | 2.2 |

TABLE 18-continued

| Mutations | CBGVA (6.39) | 5-GDVA (6.458) | nMol CBGVA | nMol 5-GDVA | Total Products | % CBGVA | % Activity | CBGVA Production |
|---|---|---|---|---|---|---|---|---|
| Q161S_Q295F | 46.2151 | 1.8605 | 17.88233246 | 0.459882341 | 18.3422148 | 97.49% | 213.43% | 2.1 |
| A53_Q295F | 43.9523 | 2.8376 | 17.0067714 | 0.701403994 | 17.70817539 | 96.04% | 206.05% | 2.0 |
| S214R_Q295F | 35.9686 | | 13.91758242 | 0 | 13.91758242 | 100.00% | 161.94% | 1.6 |
| Q161S_S177W | 32.4331 | 2.5717 | 12.54956663 | 0.635678268 | 13.1852449 | 95.18% | 153.42% | 1.5 |
| Q16S_S214R | 29.2403 | | 11.31415416 | 0 | 11.31415416 | 100.00% | 131.65% | 1.3 |
| A53T_S177W | 15.4625 | 8.8346 | 5.983013465 | 2.183755191 | 8.166768656 | 73.26% | 95.03% | 0.7 |
| A53T_V294A_Q295W | 14.5967 | 8.5727 | 5.648003405 | 2.119018193 | 7.767021598 | 72.72% | 84.09% | 0.6 |
| A53T_Q161S_V294A_Q295W | 13.4626 | 11.7614 | 5.209178146 | 2.907207831 | 8.116385977 | 64.18% | 87.88% | 0.6 |
| A53T_Q295W | 12.1532 | 7.1918 | 4.702522829 | 1.777684398 | 6.480207227 | 72.57% | 70.16% | 0.5 |
| Q161S_V294A_Q295A | 11.5893 | 6.1801 | 4.484329051 | 1.527610243 | 6.011939294 | 74.59% | 65.09% | 0.5 |
| A53T_Q161S_V294N_Q295W | 11.3653 | 13.5299 | 4.397655162 | 3.344349417 | 7.742004578 | 56.80% | 83.82% | 0.5 |
| A53T_Q161S | 10.4118 | 26.798 | 4.028710726 | 6.623986553 | 10.65269728 | 37.82% | 123.95% | 0.5 |
| A53T_Q161S_Q295W | 10.4226 | 5.6942 | 4.032889646 | 1.407504449 | 5.440394095 | 74.13% | 58.90% | 0.4 |
| S177W_S214R | 8.898 | | 3.442965485 | 0 | 3.442965485 | 100.00% | 40.06% | 0.4 |
| A53T_Q161S_V294A_Q295A | 8.3752 | 9.5435 | 3.240674818 | 2.358982598 | 5.599657417 | 57.87% | 60.63% | 0.4 |
| A53T_Q161S_V294N_Q295A | 7.7662 | 7.1111 | 3.005030181 | 1.7577368 | 4.762766982 | 63.09% | 51.57% | 0.3 |
| A53T_Q161S_Q295A | 6.9677 | 7.6228 | 2.696060981 | 1.884219893 | 4.580280874 | 58.86% | 49.59% | 0.3 |
| A53T_Q161S_V294A | 5.7154 | 18.9083 | 2.211499768 | 4.673793751 | 6.885293519 | 32.12% | 74.55% | 0.2 |
| Q161S_V294A_Q295W | 5.3676 | 3.451 | 2.076923077 | 0.853025509 | 2.929948586 | 70.89% | 31.72% | 0.2 |
| A53T_Q161S_V294N | 4.6934 | 17.5207 | 1.816050147 | 4.330803836 | 6.146853983 | 29.54% | 66.55% | 0.2 |
| V49A_S214R | 3.7232 | 0.2083 | 1.440643863 | 0.051488036 | 1.4921319 | 96.55% | 17.36% | 0.2 |
| A53T_V294A | 2.2627 | 34.0135 | 0.875523365 | 8.407529167 | 9.283051532 | 9.43% | 100.51% | 0.1 |
| A53T_V294A_Q295A | 1.874 | 10.6083 | 0.72511995 | 2.622182124 | 3.347302074 | 21.66% | 36.24% | 0.1 |
| A53T_Q295A | 1.7119 | 12.918 | 0.662397462 | 3.193098675 | 3.855496137 | 17.18% | 41.74% | 0.1 |
| V49A_Q295L | 1.4388 | 1.2094 | 0.556724965 | 0.298942061 | 0.855667026 | 65.06% | 9.96% | 0.1 |

Example 5: Generation of ORF2 Variants with Improved Enzymatic Function Using DVA as Substrate and GPP as Donor Four triple mutants (A09 carrying V49A_Q161S_V294A; E9 carrying A53T_M106E_Q161S; G12 carrying A17T_Q161W_A232S; and D12 carrying A53T_E112D_G205M) that had improved activity vs. the WT ORF2, based on FIG. 27 were targeted for "breakdown" analysis. For each parental clone targeted six unique mutants are generated (3 doubles and 3 singles).

Figure 47:
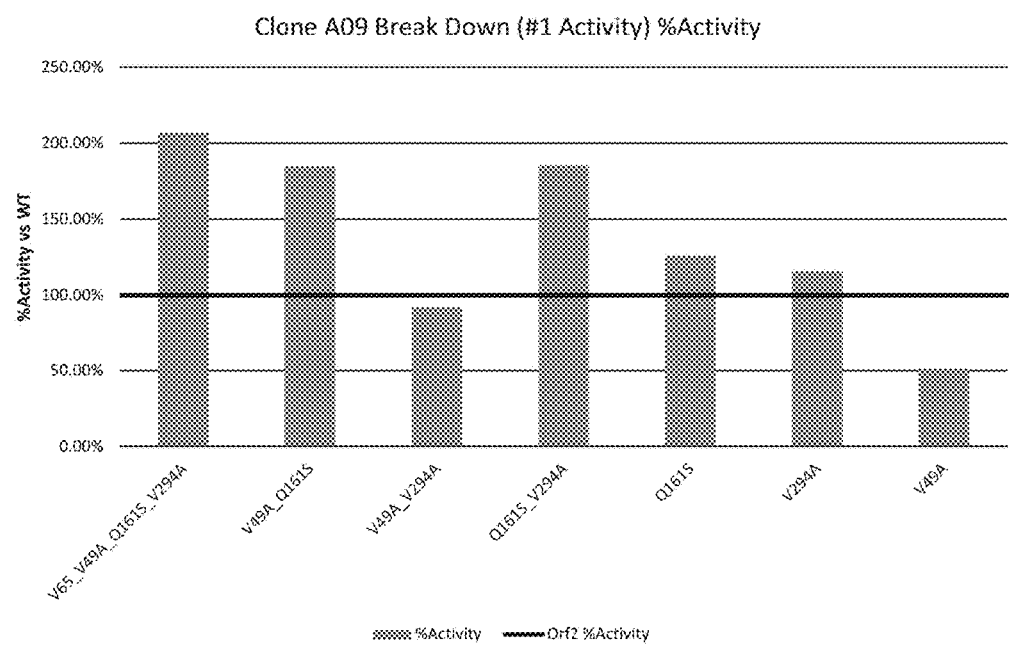
FIG. 47 shows % enzymatic activity (using DVA as substrate and GPP as donor) of ORF2 mutants derived from breakdown of A09 mutant clone.
Figure 48:
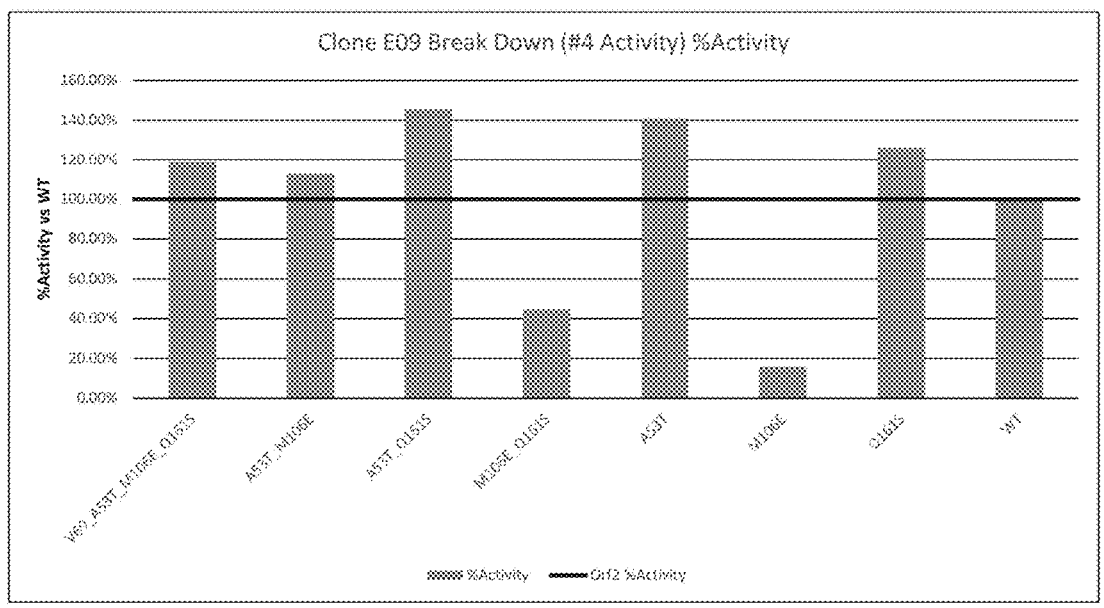
FIG. 48 shows % enzymatic activity (using DVA as substrate and GPP as donor) of ORF2 mutants derived from breakdown of E09 mutant clone.

The % enzymatic activity when using DVA as substrate and GPP as donor was calculated for each of the single and double mutants derived from the breakdown analysis of A09 and E09. FIGS. 47 and 48 depict the % activity for the mutants derived from the breakdown of A09 (FIG. 47); and E09 (FIG. 48) triple mutant clones.

In a similar fashion, breakdown analysis for the other two triple mutants—G12 and D12—will also be done; and the % activity for the mutants derived from the breakdown will be measured, as described above.

Figure 49:
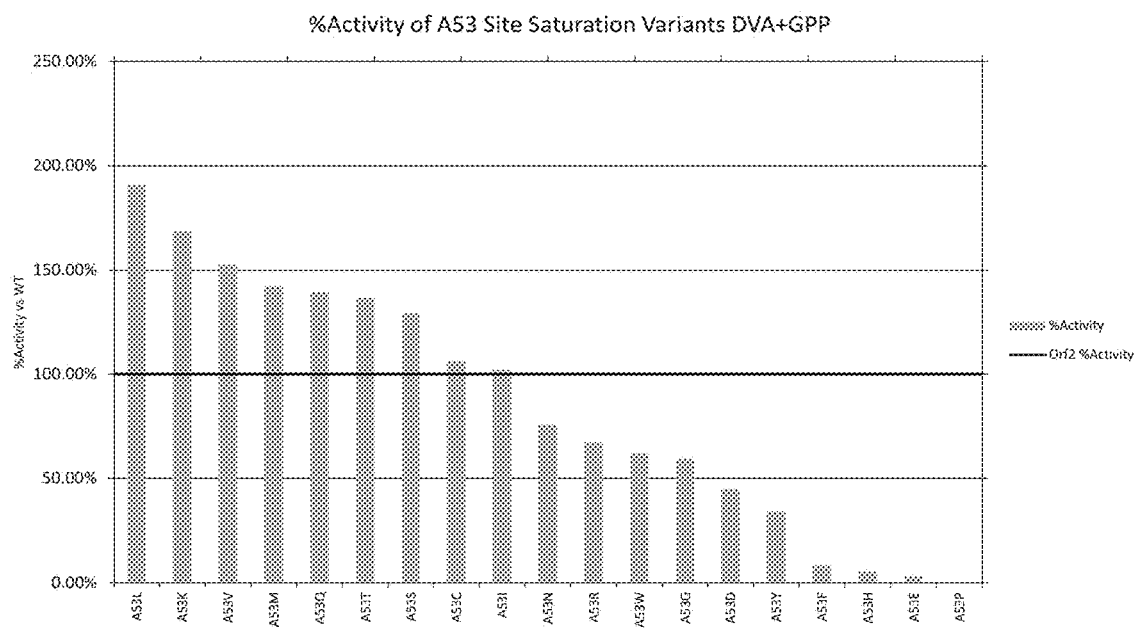
FIG. 49 shows % enzymatic activity (using DVA as substrate and GPP as donor) of Q295 site-saturated ORF2 mutants.
Figure 50:
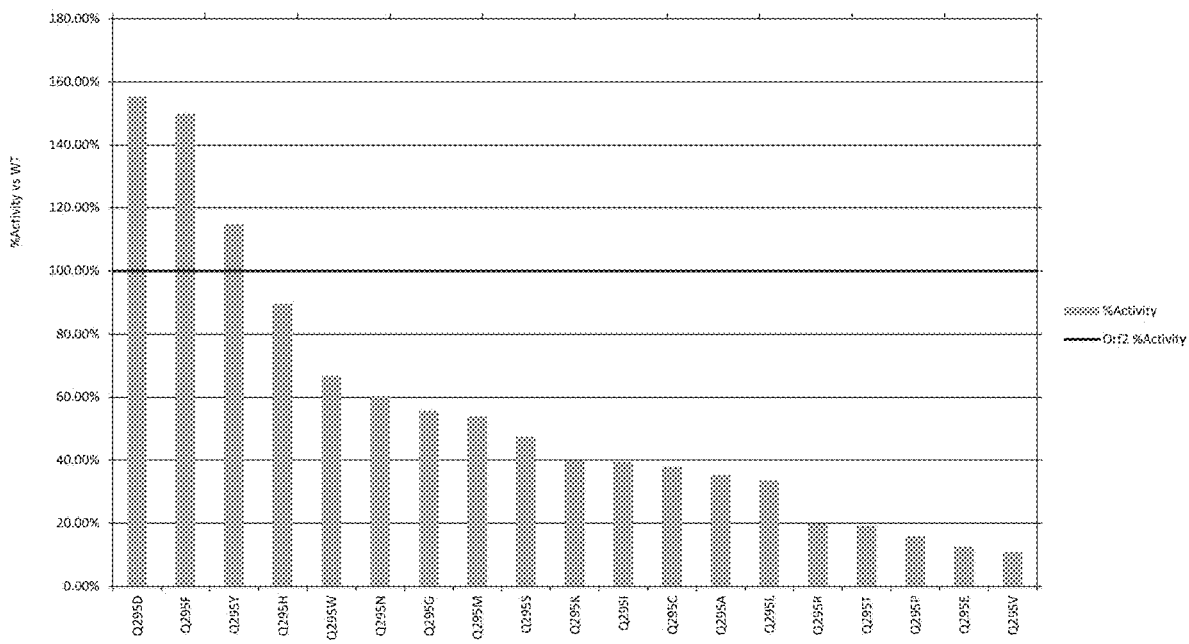
FIG. 50 shows % enzymatic activity (using DVA as substrate and GPP as donor) of A53 site-saturated ORF2 mutants.
Figure 51:
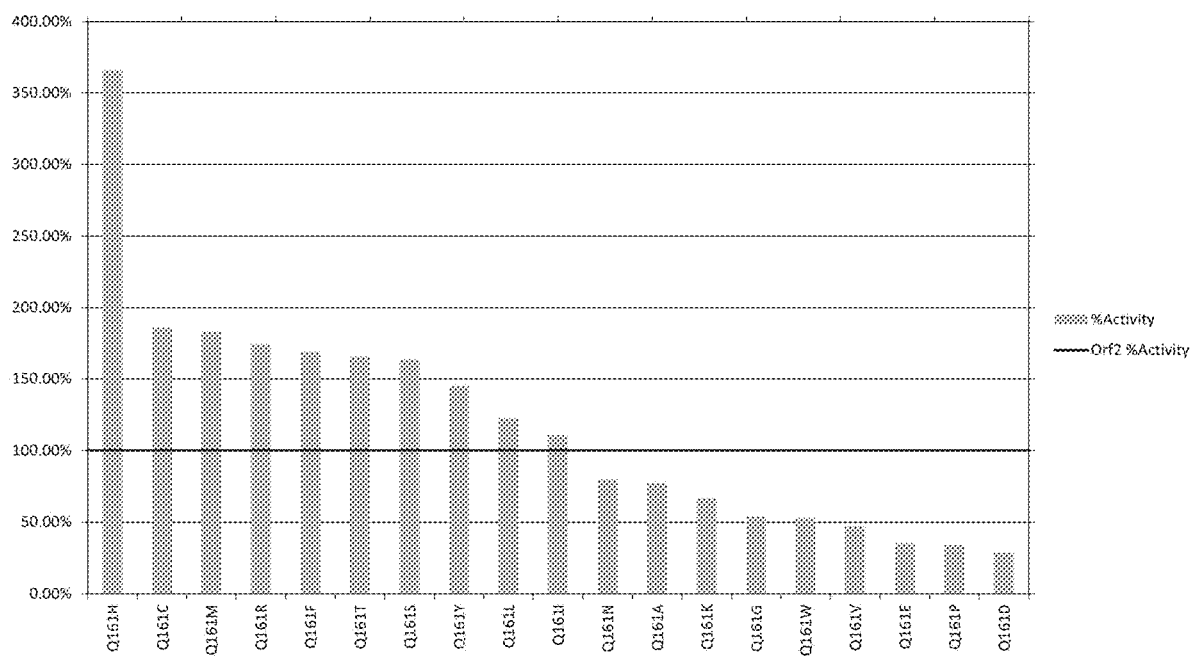
FIG. 51 shows % enzymatic activity (using DVA as substrate and GPP as donor) of Q161 site-saturated ORF2 mutants.

Based on the breakdown analysis of triple mutants A09 and E09: V49, Q161, A53 and Q295 were selected for performing site-saturated mutagenesis. % enzymatic activity (when using DVA as substrate and GPP as donor) of site-saturated mutants of A53, Q295 and Q161 described in Examples 1 and 2 was determined, and was compared to that of WT ORF2. These results are shown in FIG. 49 (A53), FIG. 50 (Q295), and FIG. 51 (Q161); and Tables 19, 20 and 21.

TABLE 19

Site saturated mutants of A53

| Mutations | nMol CBGVA | nMol 5-GDVA | Total Products | % Activity |
|---|---|---|---|---|
| A53L | 2.143514936 | 9.210351987 | 11.35386692 | 190.81% |
| A53K | 1.275383068 | 8.751705557 | 10.02708862 | 168.52% |
| A53V | 2.534553475 | 7.935633775 | 10.47018725 | 152.77% |
| A53M | 1.582688438 | 8.177328456 | 9.760016894 | 142.40% |
| A53Q | 1.078548212 | 7.218162942 | 8.296711155 | 139.43% |
| A53T | 1.075065779 | 10.81335278 | 11.88841856 | 136.63% |
| A53S | 1.338492493 | 7.507118845 | 8.845611339 | 129.06% |
| A53C | 1.754449776 | 7.060955112 | 8.815404887 | 1.06289 |
| A53I | 2.838724656 | 6.020367807 | 8.859092463 | 101.81% |
| A53N | 0.540164061 | 4.653129326 | 5.193293387 | 75.77% |
| A53R | 0.705811794 | 5.140523037 | 5.846334831 | 67.19% |
| A53W | 0.3875948 | 5.026596797 | 5.414191596 | 62.22% |
| A53G | 0.675475933 | 3.400830532 | 4.076306464 | 59.48% |
| A53D | 0.480691843 | 2.19952541 | 2.680217254 | 45.04% |
| A53Y | 0.493151215 | 1.538090765 | 2.03124198 | 34.14% |
| A53F | 0.470863643 | 0.246860787 | 0.71772443 | 8.35% |
| A53H | 0.167311562 | 0.30047459 | 0.467786151 | 5.44% |
| A53E | 0.032154465 | 0.156837058 | 0.188991523 | 3.18% |
| A53P | 0.000580406 | 0.021925054 | 0.02250546 | 0.002714 |

TABLE 20

Site saturated mutants of Q295

| Mutations | nMol CBGVA | nMol 5-GDVA | Total Products | % CBGVA | % Activity | CBGVA Production Potential |
|---|---|---|---|---|---|---|
| Q295D | 1.29140226 | 9.345758355 | 10.63716061 | 12.14% | 155.20% | 0.19 |
| Q295F | 13.57351803 | 0.283839233 | 13.85735726 | 97.95% | 150.03% | 1.47 |

TABLE 20-continued

Site saturated mutants of Q295

| Mutations | nMol CBGVA | nMol 5-GDVA | Total Products | % CBGVA | % Activity | CBGVA Production Potential |
|---|---|---|---|---|---|---|
| Q295Y | 1.501276892 | 6.363975677 | 7.865252569 | 19.09% | 114.76% | 0.22 |
| Q295H | 3.540705773 | 4.739840815 | 8.280546588 | 42.76% | 89.65% | 0.38 |
| Q295W | 4.568410463 | 1.598897568 | 6.167308031 | 74.07% | 66.77% | 0.49 |
| Q295N | 0.511492029 | 5.062710105 | 5.574202134 | 9.18% | 60.35% | 0.06 |
| Q295G | 0.703722334 | 4.449401819 | 5.153124153 | 13.66% | 55.79% | 0.08 |
| Q295M | 3.386047052 | 1.594695472 | 4.980742523 | 67.98% | 53.93% | 0.37 |
| Q295S | 0.480420987 | 3.918108562 | 4.39852955 | 10.92% | 47.62% | 0.05 |
| Q295K | 0.249922613 | 2.476591853 | 2.726514465 | 9.17% | 39.78% | 0.04 |
| Q295I | 3.401176289 | 0.248071979 | 3.649248268 | 93.20% | 39.51% | 0.37 |
| Q295C | 1.126799257 | 2.37638422 | 3.503183477 | 32.17% | 37.93% | 0.12 |
| Q295A | 0.775344374 | 2.481832114 | 3.257176488 | 23.80% | 35.27% | 0.08 |
| Q295L | 2.095728215 | 0.998467471 | 3.094195686 | 67.73% | 33.50% | 0.23 |
| Q295R | 0.038925863 | 1.778425944 | 1.817351807 | 2.14% | 19.68% | 0.00 |
| Q295T | 0.343174431 | 1.441393118 | 1.78456755 | 19.23% | 19.32% | 0.04 |
| Q295P | 0.579322086 | 0.893439786 | 1.472761873 | 39.34% | 15.95% | 0.06 |
| Q295E | 0.68298251 | 0.480324303 | 1.163306813 | 58.71% | 12.60% | 0.07 |
| Q295V | 0.736921529 | 0.261963615 | 0.998885144 | 73.77% | 10.81% | 0.08 |

TABLE 21

Site saturated mutants of Q161

| Mutations | nMol CBGVA | nMol 5-GDVA | Total Products | % CBGVA | % Activity | CBGVA Production |
|---|---|---|---|---|---|---|
| Q161H | 31.43685188 | 0 | 31.43685188 | 100.00% | 365.79% | 3.66 |
| Q161C | 0.342207089 | 10.68046767 | 11.02267476 | 3.10% | 185.25% | 0.06 |
| Q161M | 0.526466491 | 10.36728792 | 10.89375441 | 4.83% | 183.08% | 0.09 |
| Q161R | 9.435304132 | 0.931753016 | 10.36705715 | 91.01% | 174.23% | 1.59 |
| Q161F | 3.890728989 | 6.157108958 | 10.04783795 | 38.72% | 168.86% | 0.65 |
| Q161T | 2.700278595 | 7.140523037 | 9.840801632 | 27.44% | 165.38% | 0.45 |
| Q161S | 4.812335552 | 4.916106387 | 9.728441939 | 49.47% | 163.50% | 0.81 |
| Q161Y | 8.142121963 | 0.489148705 | 8.631270667 | 94.33% | 145.06% | 1.37 |
| Q161L | 0.836673889 | 6.451057939 | 7.287731829 | 11.48% | 122.48% | 0.14 |
| Q161I | 0.501315586 | 6.070026696 | 6.571342281 | 7.63% | 110.44% | 0.08 |
| Q161N | 0.992802972 | 4.474688551 | 5.467491522 | 18.16% | 79.77% | 0.14 |
| Q161A | 1.775886086 | 4.850479533 | 6.626365619 | 26.80% | 77.10% | 0.21 |
| Q161K | 5.035404736 | 0.710945224 | 5.746349961 | 87.63% | 66.86% | 0.59 |
| Q161G | 0.999961306 | 2.683112517 | 3.683073824 | 27.15% | 53.74% | 0.15 |
| Q161W | 0.193778053 | 4.411879573 | 4.605657626 | 4.21% | 52.93% | 0.02 |
| Q161V | 0.594335242 | 3.318741349 | 3.913076591 | 15.19% | 0.471807246 | 0.07 |
| Q161E | 1.672070887 | 1.24184299 | 2.913913877 | 57.38% | 0.351336257 | 0.20 |
| Q161P | 0.78366352 | 2.170333202 | 2.953996721 | 26.53% | 33.95% | 0.09 |
| Q161D | 1.211654543 | 1.262013051 | 2.473667594 | 48.98% | 28.43% | 0.14 |

Similarly, site saturated mutants of V49 will also be generated; and the % activity of these mutants will be compared to that of the WT ORF2 in a reaction using DVA as substrate and GPP as donor.

From the results described above, multiple mutations of A53, Q295, and Q161 that have significantly higher % activity, as compared to WT ORF2, were identified. Thus, the ORF2 mutants disclosed herein have unexpectedly superior enzymatic functions, in a reaction using DVA as a substrate and GPP as donor, as compared to WT ORF2.

Figure 52:
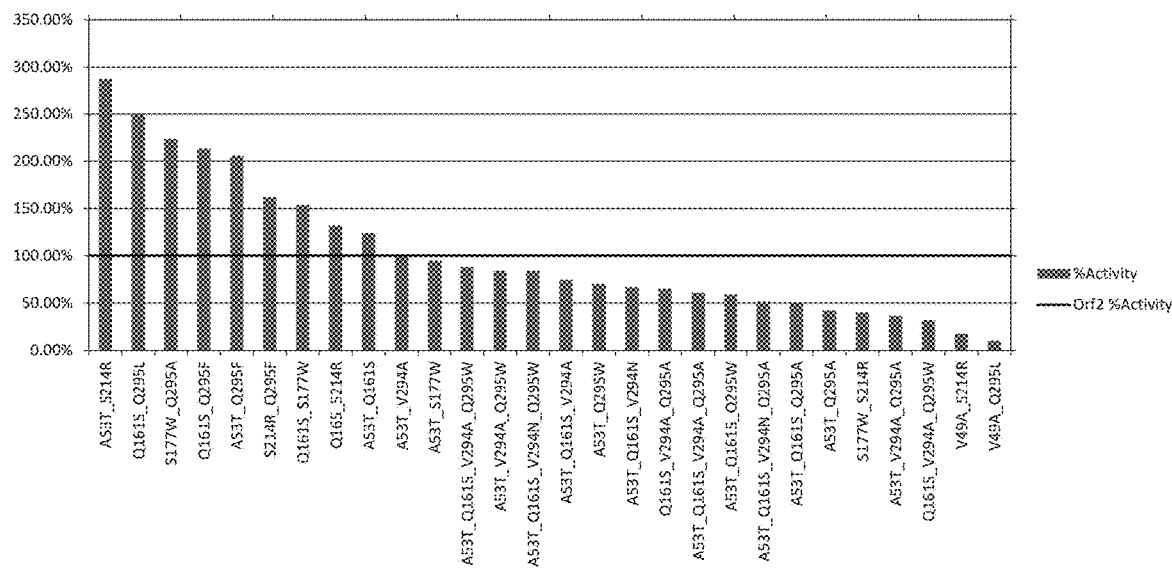
FIG. 52 shows % enzymatic activity (using DVA as substrate and GPP as donor) of stacking ORF2 mutants.

Finally, ORF2 stacking mutant clones that carry different novel combinations of the mutations that our analysis identified as being important for ORF2's % enzymatic activity were analyzed to measure their % enzymatic activity, as shown in FIG. 52.

The analysis of the stacking mutants shows that multiple stacking mutants have significantly higher % enzymatic activity, compared to the WT ORF2, thereby indicating that the ORF2 stacking mutants disclosed herein have synergistically enhanced effects compared to the individual single mutants. Thus, the ORF2 stacking mutants disclosed herein have unexpectedly superior enzymatic functions, in a reaction using DVA and GPP, as compared to WT ORF2.

Example 6: Generation of ORF2 Variants which Synthesize an Altered Amount of CBG and/or 5-GO Using Olivetol (Referred to Herein as "0") and GPP, Compared to WT ORF2

The library of tripleton mutants was screened for the ability to produce CBG and 5-GO using O as substrate and Geranyl pyrophosphate (GPP) as donor; and this enzymatic activity was compared to that of the WT ORF2. Table 22 provides the summary of the analysis performed on the enzymatic activity of the ORF2 triple mutants to produce CBG and 5-GO using O as substrate and Geranyl pyrophosphate (GPP) as donor. Table 9 lists the mutations within each of the tripleton mutants as well the nMol CBG, nMol of 5-GO, total prenylated products, % CBG products among prenylated products, % enzymatic activity, CBG production potential and %5-GO among total prenylated products of each of the ORF2 triple mutants.

TABLE 22

| CLONE ID | Mutations | CBG (7.095) | 5-GO (7.745) | nMol CBG | nMol 5-GO | Total nMol Products | % CBG | % Activity | CBG Production | % GOA |
|---|---|---|---|---|---|---|---|---|---|---|
| E09 | A53T_M106E_Q161S | 3.1916 | 1.3656 | 13.04290969 | 3.762190754 | 16.80510044 | 77.61% | 406.28% | 3.15 | 22.39% |
| C06 | Q161A_M162F_Q295A | 1.8681 | 0.787 | 7.634246016 | 2.168163535 | 9.802409551 | 77.88% | 219.65% | 1.71 | 22.12% |
| D12 | A53T_E112D_G205M | 1.5896 | 1.2489 | 6.496117695 | 3.440685437 | 9.936803132 | 65.37% | 240.23% | 1.57 | 34.63% |
| G12 | A17T_Q161W_A232S | 1.0678 | 0.4634 | 4.363710666 | 1.276654361 | 5.640365027 | 77.37% | 136.36% | 1.05 | 22.63% |
| C11 | E112D_L219F_V294F | 0.8983 | 0.8995 | 3.671025746 | 2.478097967 | 6.149123713 | 59.70% | 137.79% | 0.82 | 40.30% |
| A09 | V49A_Q161S_V294A | 0.703 | 0.8977 | 2.872905599 | 2.473139016 | 5.346044615 | 53.74% | 119.79% | 0.64 | 46.26% |
| D06 | A53E_Q161A_V294N | 0.5894 | 0.7298 | 2.40866367 | 2.010579095 | 4.419242765 | 54.50% | 99.03% | 0.54 | 45.50% |
| A04 | L219F_V294N_Q295A | 0.5735 | 0.4173 | 2.343686146 | 1.149650118 | 3.493336265 | 67.09% | 78.28% | 0.53 | 32.91% |
| H11 | A108G_Q161S_G205M | 0.4996 | 0.4828 | 2.041683694 | 1.330100832 | 3.371784526 | 60.55% | 81.52% | 0.49 | 39.45% |
| H02 | A53Q_S177W_L219F | 0.4683 | 0.4481 | 1.913771966 | 1.234503278 | 3.148275244 | 60.79% | 76.11% | 0.46 | 39.21% |
| D04 | A53T_D166E_Q295W | 0.405 | 0.6084 | 1.655087863 | 1.676125406 | 3.331213269 | 49.68% | 74.65% | 0.37 | 50.32% |
| H09 | E112G_G205M_L298W | 0.355 | 0.6902 | 1.450756028 | 1.901482175 | 3.352238203 | 43.28% | 81.04% | 0.35 | 56.72% |
| C05 | A53Q_S177Y_Y288H | 0.371 | 0.703 | 1.516142215 | 1.936745826 | 3.452888041 | 43.91% | 77.37% | 0.34 | 56.09% |
| F09 | Q38G_D166E_Q295A | 0.3134 | 0.3094 | 1.280751941 | 0.852388561 | 2.133140503 | 60.04% | 51.57% | 0.31 | 39.96% |
| H10 | M162A_N173D_S214F | 0.3072 | 0.5322 | 1.255414794 | 1.466196485 | 2.721611278 | 46.13% | 65.80% | 0.30 | 53.87% |
| H06 | V49L_E112D_G286E | 0.3004 | 0.3258 | 1.227625664 | 0.897570114 | 2.125195778 | 57.77% | 51.38% | 0.30 | 42.23% |
| A05 | A17T_C25V_E112G | 0.3182 | 0.3457 | 1.300367797 | 0.952394071 | 2.252761869 | 57.72% | 50.48% | 0.29 | 42.28% |
| D11 | F123H_L174V_S177E | 0.2886 | 0.3135 | 1.179403351 | 0.86368395 | 2.043087301 | 57.73% | 49.39% | 0.29 | 42.27% |
| B08 | K118Q_L174V_R228Q | 0.3098 | 0.3717 | 1.266040049 | 1.024023362 | 2.290063411 | 55.28% | 51.32% | 0.28 | 44.72% |
| A02 | Q38G_E112D_F123H | 0.3065 | 0.4033 | 1.252554148 | 1.1110805 | 2.363634648 | 52.99% | 52.96% | 0.28 | 47.01% |
| G05 | A53T_K118N_S214F | 0.2765 | 0.3188 | 1.129955047 | 0.878285305 | 2.008240352 | 56.27% | 48.55% | 0.27 | 43.73% |
| B10 | M106E_Y121W_D166E | 0.2878 | 0.3451 | 1.176134042 | 0.950741088 | 2.126875129 | 55.30% | 47.66% | 0.26 | 44.70% |
| H05 | S177E_S214R_R228E | 0.2652 | 0.3543 | 1.083776052 | 0.976086837 | 2.059862889 | 52.61% | 49.80% | 0.26 | 47.39% |
| C12 | N173D_F213M_V294F | 0.2854 | 0.6328 | 1.166326114 | 1.743346741 | 2.909672854 | 40.08% | 65.20% | 0.26 | 59.92% |
| B09 | C25V_F213M_Y216A | 0.2775 | 0.3398 | 1.134041684 | 0.936139732 | 2.070181416 | 54.78% | 46.39% | 0.25 | 45.22% |
| D01 | K118Q_Q161W_S214F | 0.2761 | 0.3493 | 1.128320392 | 0.962311973 | 2.090632365 | 53.97% | 46.85% | 0.25 | 46.03% |
| C02 | K118N_K119A_V271E | 0.2744 | 0.3159 | 1.12137311 | 0.870295884 | 1.991668994 | 56.30% | 44.63% | 0.25 | 43.70% |
| B06 | D166E_S177S_S214F | 0.2696 | 0.3306 | 1.101757254 | 0.910793983 | 2.012551237 | 54.74% | 45.10% | 0.25 | 45.26% |
| B05 | A53Q_Y121W_A232S | 0.2661 | 0.3326 | 1.087454025 | 0.916303929 | 2.003757954 | 54.27% | 44.90% | 0.24 | 45.73% |
| G03 | L219F_Y283L_L298W | 0.2448 | 0.4232 | 1.000408664 | 1.165904458 | 2.166313121 | 46.18% | 52.37% | 0.24 | 53.82% |
| H01 | K119A_Q161A_R228Q | 0.24 | 0.3273 | 0.980792808 | 0.901702573 | 1.882495381 | 52.10% | 45.51% | 0.24 | 47.90% |
| G09 | M106E_G205L_C209G | 0.2391 | 0.323 | 0.977114834 | 0.88985619 | 1.866971025 | 52.34% | 45.14% | 0.24 | 47.66% |
| C03 | V49L_S214R_V271E | 0.2545 | 0.3185 | 1.04004904 | 0.877458813 | 1.917507853 | 54.24% | 42.97% | 0.23 | 45.76% |
| G06 | K118Q_F123A_R228E | 0.2329 | 0.3136 | 0.951777687 | 0.863959447 | 1.815737134 | 52.42% | 43.90% | 0.23 | 47.58% |
| A12 | Y121W_S177Y_G286E | 0.2499 | 0.3016 | 1.021250511 | 0.830899774 | 1.852150285 | 55.14% | 41.50% | 0.23 | 44.86% |
| E10 | E112D_K119A_N173D | 0.2314 | 0.2803 | 0.945647732 | 0.772218855 | 1.717866587 | 55.05% | 41.53% | 0.23 | 44.95% |
| G11 | S177W_Y288H_V294N | 0.2266 | 0.3002 | 0.926031876 | 0.827042812 | 1.753074688 | 52.82% | 42.38% | 0.22 | 47.18% |
| B04 | A53E_A108G_K118N | 0.2397 | 0.2981 | 0.979566817 | 0.82125737 | 1.800824186 | 54.40% | 40.35% | 0.22 | 45.60% |
| G10 | V49A_Y121W_C230S | 0.2207 | 0.299 | 0.901920719 | 0.823736845 | 1.725657564 | 52.27% | 41.72% | 0.22 | 47.73% |
| F08 | A53T_N173D_S214R | 0.2207 | 0.2818 | 0.901920719 | 0.776351314 | 1.678272033 | 53.74% | 40.57% | 0.22 | 46.26% |
| G07 | V49S_Y216A_V294N | 0.2206 | 0.3124 | 0.901512056 | 0.86065348 | 1.762165535 | 51.16% | 42.60% | 0.22 | 48.84% |
| H07 | F123A_M162F_S214G | 0.2201 | 0.3228 | 0.899468737 | 0.889305196 | 1.788773933 | 50.28% | 43.25% | 0.22 | 49.72% |
| C07 | V49L_K119D_G205M | 0.2333 | 0.3044 | 0.953412342 | 0.838613698 | 1.792026039 | 53.20% | 40.16% | 0.21 | 46.80% |
| F12 | A17T_V49A_C230N | 0.2159 | 0.2812 | 0.882304863 | 0.77469833 | 1.657003194 | 53.25% | 40.06% | 0.21 | 46.75% |
| D03 | D227E_C230N_Q295W | 0.2291 | 0.2973 | 0.936248468 | 0.819053391 | 1.755301859 | 53.34% | 39.33% | 0.21 | 46.66% |
| C10 | A53Q_L274V_Q295A | 0.2286 | 0.298 | 0.934205149 | 0.820981872 | 1.755187021 | 53.23% | 39.33% | 0.21 | 46.77% |
| C08 | V49S_S214G_V294A | 0.2284 | 0.4829 | 0.933387822 | 1.330376329 | 2.263764151 | 41.23% | 50.73% | 0.21 | 58.77% |
| G02 | A53E_F213M_R228Q | 0.2077 | 0.302 | 0.848794442 | 0.832001763 | 1.680796205 | 50.50% | 40.63% | 0.21 | 49.50% |
| B11 | V49S_K119D_F213M | 0.2217 | 0.2841 | 0.906007356 | 0.782687751 | 1.688695107 | 53.65% | 37.84% | 0.20 | 46.35% |
| F10 | K119D_Q161W_L298Q | 0.2054 | 0.2715 | 0.839395178 | 0.747975095 | 1.587370273 | 52.88% | 38.38% | 0.20 | 47.12% |
| C01 | V49S_M162A_Y283L | 0.2213 | 0.7384 | 0.904327701 | 2.034271861 | 2.938644562 | 30.78% | 65.85% | 0.20 | 69.22% |
| B02 | V49A_S177Y_C209G | 0.2202 | 0.2682 | 0.899877401 | 0.738883685 | 1.638761086 | 54.91% | 36.72% | 0.20 | 45.09% |
| A11 | V49S_D166E_L274V | 0.2202 | 0.2631 | 0.899877401 | 0.724833324 | 1.624710725 | 55.39% | 36.41% | 0.20 | 44.61% |
| D09 | K118N_C209G_R228Q | 0.2002 | 0.2477 | 0.818144667 | 0.682406744 | 1.500551411 | 54.52% | 36.28% | 0.20 | 45.48% |
| G04 | D227E_R228E_L298Q | 0.1989 | 0.2764 | 0.812832039 | 0.761474461 | 1.574306501 | 51.63% | 38.06% | 0.20 | 48.37% |
| A10 | V49S_K118Q_S177E | 0.2141 | 0.2994 | 0.874948917 | 0.824838834 | 1.699787751 | 51.47% | 38.09% | 0.20 | 48.53% |
| B12 | A17T_F123W_L298A | 0.2115 | 0.2931 | 0.864323662 | 0.807482506 | 1.671806168 | 51.70% | 37.46% | 0.19 | 48.30% |
| C09 | A108G_K119D_L298A | 0.211 | 0.2503 | 0.862280343 | 0.689569673 | 1.551850017 | 55.56% | 34.77% | 0.19 | 44.44% |
| H04 | M162A_C209G_Y288H | 0.1947 | 0.2801 | 0.795668165 | 0.77166786 | 1.567336026 | 50.77% | 37.89% | 0.19 | 49.23% |
| D08 | E112D_K119A_N173D | 0.1903 | 0.2403 | 0.777686964 | 0.662019946 | 1.43970691 | 54.02% | 34.81% | 0.19 | 45.98% |
| A03 | V49L_F123A_Y283L | 0.1942 | 0.2095 | 0.793624847 | 0.577166786 | 1.370791633 | 57.90% | 30.72% | 0.18 | 42.10% |
| A07 | G205L_R228E_C230N | 0.194 | 0.2399 | 0.792807519 | 0.660917957 | 1.453725476 | 54.54% | 32.57% | 0.18 | 45.46% |
| A08 | C25V_A232S_V271E | 0.1891 | 0.2273 | 0.772783 | 0.626205301 | 1.3989883 | 55.24% | 31.35% | 0.17 | 44.76% |
| D07 | K119A_S214G_L298A | 0.1708 | 0.2959 | 0.697997548 | 0.81519643 | 1.513193978 | 46.13% | 36.58% | 0.17 | 53.87% |
| D10 | V49A_F123A_Y288H | 0.136 | 0.1827 | 0.555782591 | 0.503333517 | 1.059116108 | 52.48% | 25.61% | 0.13 | 47.52% |

Figure 53:
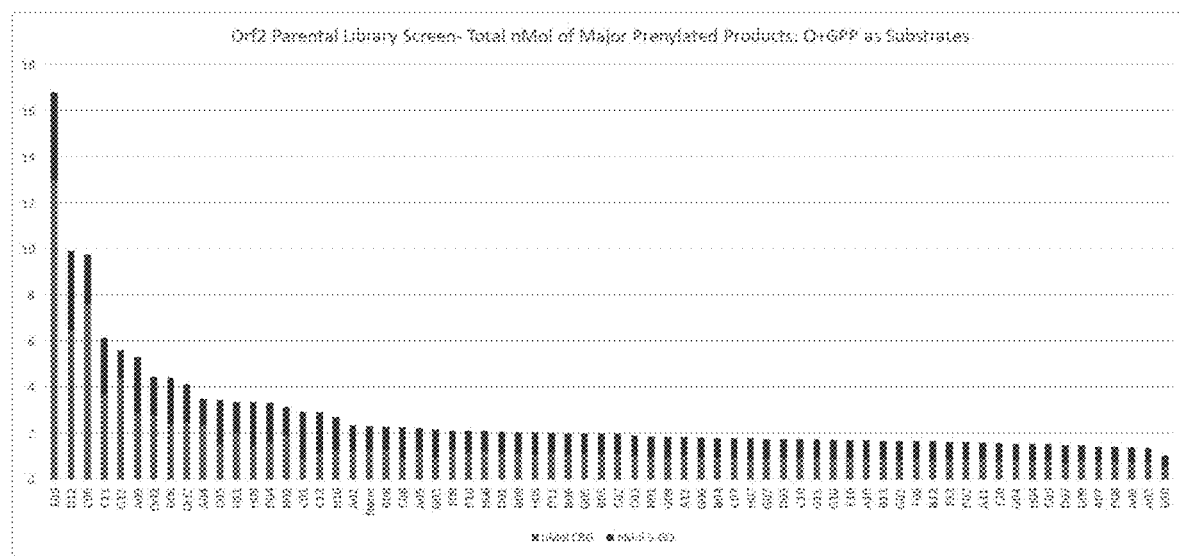
FIG. 53 shows the total nMol of prenylated products produced by ORF2 triple mutants using O as substrate and GPP as donor.

The amount of CBG or 5-GO (in nMols) generated by each of the ORF2 triple mutant clones was measured using HPLC. FIG. 53 shows the total nMols of prenylated products generated using O as substrate and GPP as donor by each of the ORF2 mutants, and the proportion of CBG and 5-GO within the total prenylated products. An exemplary wild type ORF2 replicate is included in the graph for comparison purposes.

Figure 54:
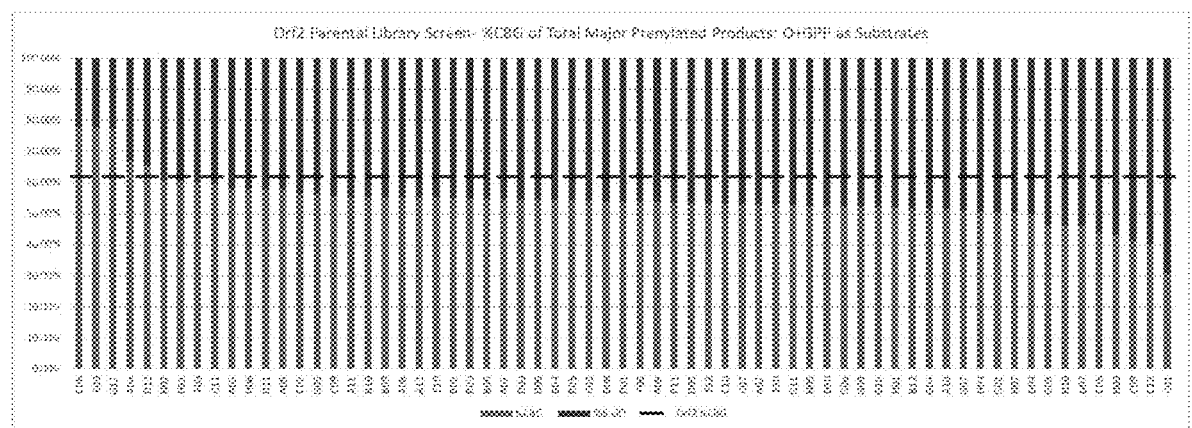
FIG. 54 shows % CBG and % GO produced by ORF2 triple mutants using O as substrate and GPP as donor.

FIG. 54 shows the % CBG and %5-GO within the total prenylated products produced by each of the ORF2 triple mutant clones using O as substrate and GPP as donor. In this graph, the mutant clones are ordered based on decreasing % CBG (from left to right) they produce, with the % GO depicted in red. The black dashed line on the graph indicates the % CBG that is produced by the wild type enzyme.

Figure 55:
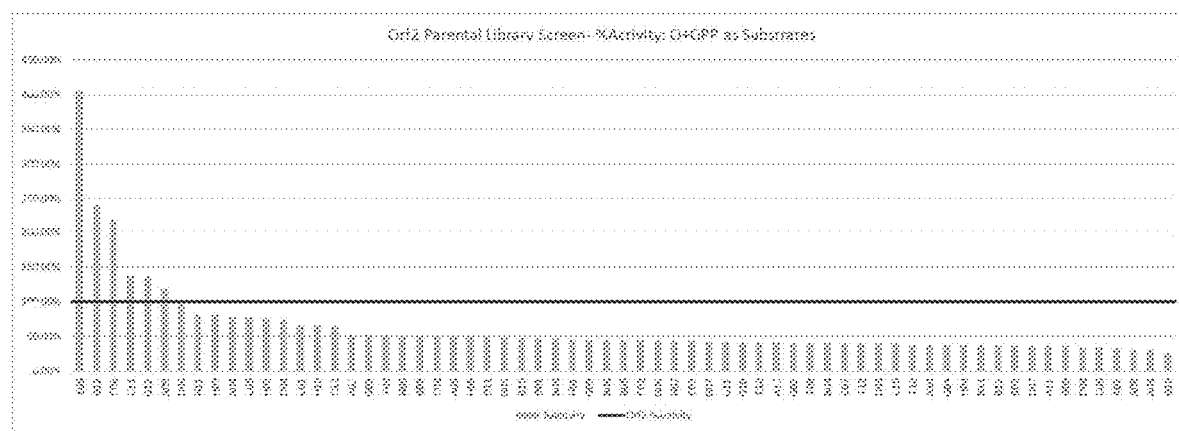
FIG. 55 shows % enzymatic activity (using O as substrate and GPP as donor) of ORF2 triple mutants.

FIG. 55 shows the ORF2 enzymatic activity (using O as substrate and GPP as donor) of each of the triple mutant ORF2 clones relative to the wild type enzyme. % activity was calculated by dividing the nMols of total prenylated products produced by a mutant by the nMols of total prenylated products produced by the wild type control, and expressed as a percentage. The red threshold line is the wild type Orf2% activity.

Figure 56:
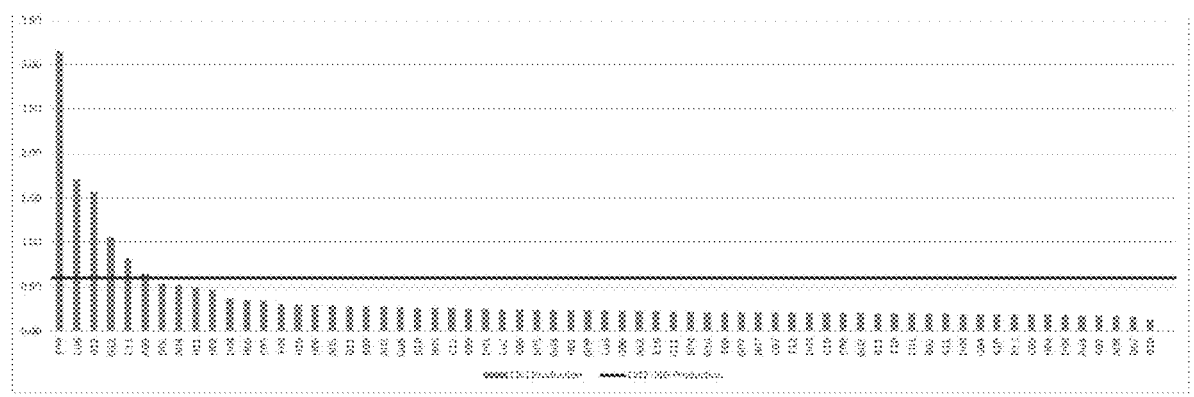
FIG. 56 shows the CBG production potential (using O as substrate and GPP as donor) of ORF2 triple mutants.

FIG. 56 shows the CBG production potential of each of the ORF2 triple mutant clones when using O as substrate and GPP as donor. CBG production potential (interchangeably referred to herein as CBG production quotient) represents the improvement in CBG production vs. the wild type enzyme. CBG production potential was calculated by multiplying the % CBG of the Total Products by the % Activity of each mutant.

While the CBG production potential analysis shown in FIG. 56 is useful to rank ORF2 mutant clones based on the amount of CBG produced, such an analysis would not differentiate between a mutant that made 100% CBG but was 20% as active as wild type ORF2; or a mutant that made 10% CBG and was 200% as active as wild type ORF2. Therefore, we employed a cluster analysis by plotting the CBG Production Potential vs. %5-GO (FIG. 57). %5-GO was calculated in a similar manner as % CBG. We used the top 25 mutants ranked based on their CBG production potential for this analysis. High 5-GO producing mutants cluster together towards the right of the graph and high CBG producing mutants cluster towards the left of the graph.

Figure 57:
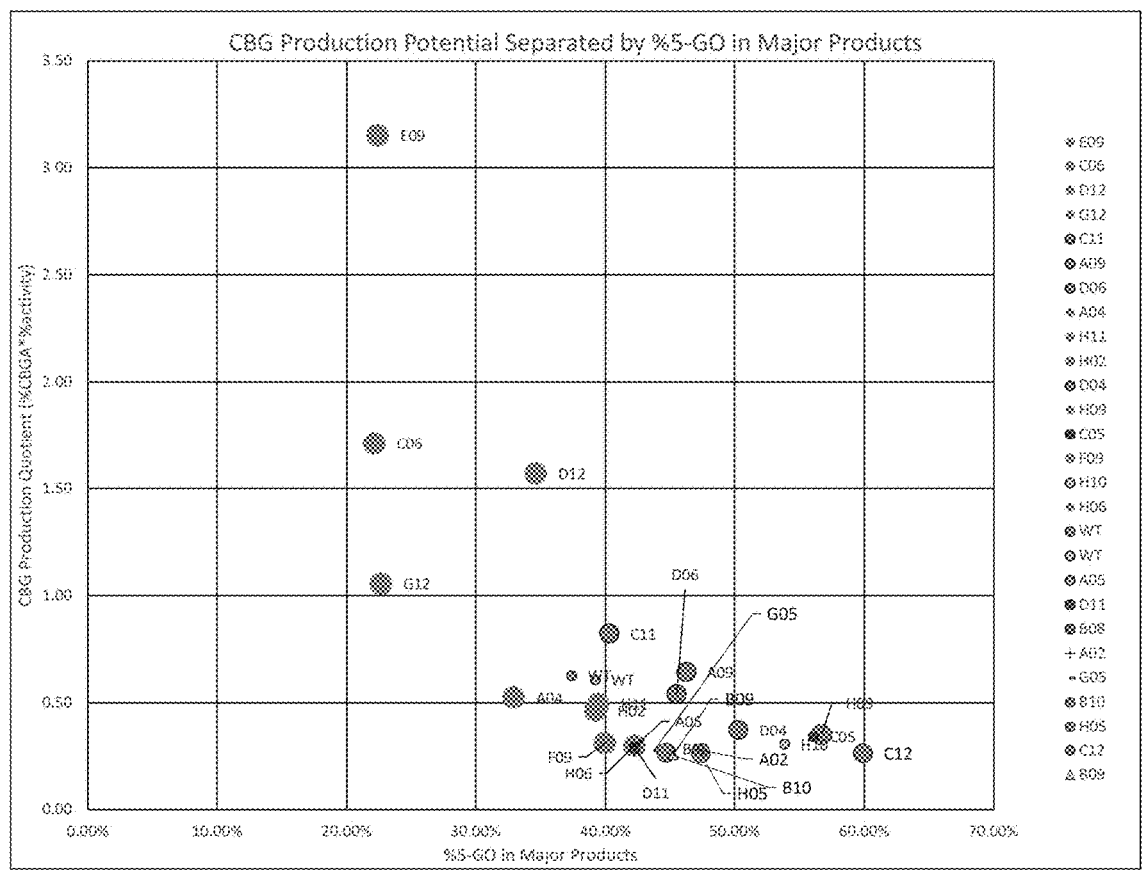
FIG. 57 shows a cluster graph of CBG production potential of ORF2 triple mutants vs. % GO produced by ORF2 triple mutants (using O as substrate and GPP as donor).

Based on the analysis performed in FIG. 57, 19 mutants which cluster to the left of the graph were selected for "breakdown" analysis (Table 23). For each parental clone targeted six unique mutants are generated (3 doubles and 3 singles).

TABLE 23

| CBG Production Rank | Clone ID | Mutations |
|---|---|---|
| 1 | E09 | A53T_M106E_Q161S |
| 2 | C06 | Q161A_M162F_Q295A |
| 3 | D12 | A53T_E112D_G205M |
| 4 | G12 | A17T_Q161W_A232S |
| 5 | C11 | E112D_L219F_V294F |
| 6 | A09 | V49A_Q161S_V294A |
| 7 | D06 | A53E_Q161A_V294N |
| 8 | A04 | L219F_V294N_Q295A |
| 9 | H11 | A108G_Q161S_G205M |
| 10 | H02 | A53Q_S177W_L219F |
| 11 | D04 | A53T_D166E_Q295W |
| 13 | C05 | A53Q_S177Y_Y288H |
| 14 | F09 | Q38G_D166E_Q295A |
| 16 | H06 | V49L_E112D_G286E |
| 17 | A05 | A17T_C25V_E112G |
| 18 | D11 | F123H_L174V_S177E |
| 19 | B08 | K118Q_L174V_R228Q |
| 20 | A02 | Q38G_E112D_F123H |
| 21 | G05 | A53T_K118N_S214F |

Figure 58A:
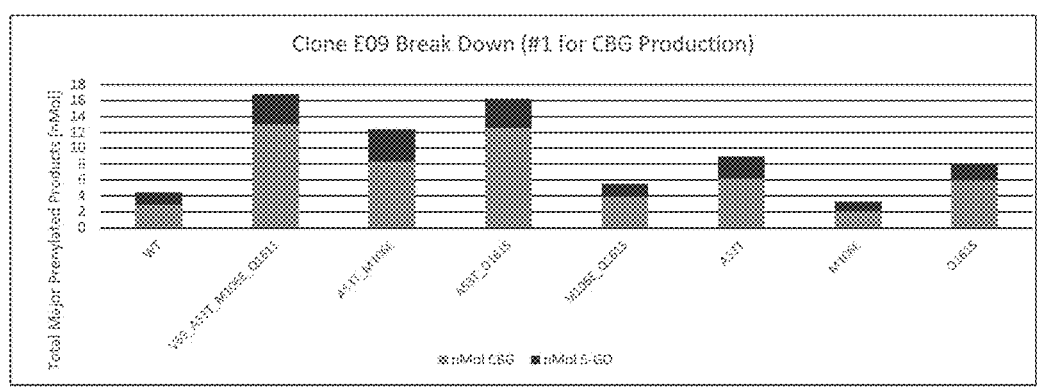
FIG. 58 shows the analysis of ORF2 enzymatic function (using O as substrate and GPP as donor)—including total nMol of prenylated products (FIG. 58A) and % CBG produced (FIG. 58B)—of ORF2 mutants derived from breakdown of E09 triple mutant.
Figure 58B:
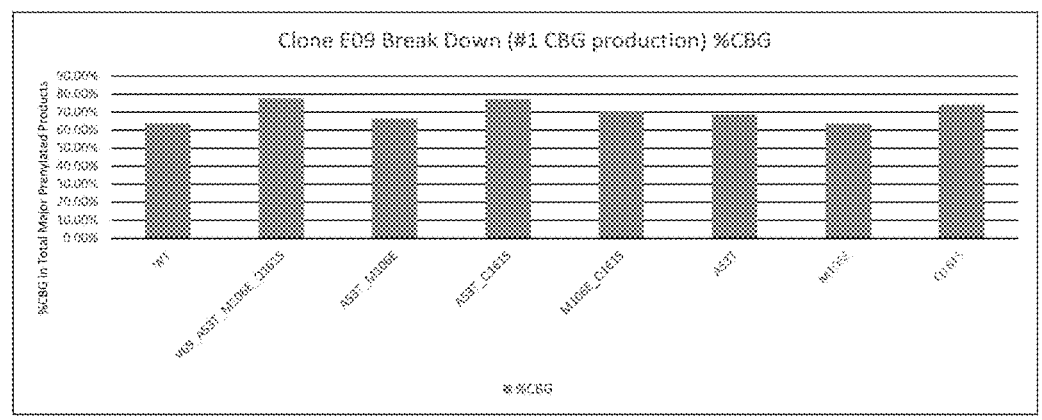
Figure 59A:
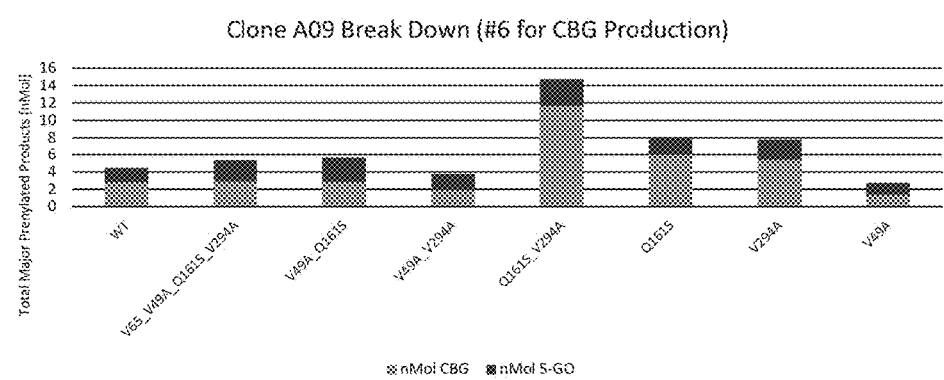
FIG. 59 shows the analysis of ORF2 enzymatic function (using O as substrate and GPP as donor)—including total nMol of prenylated products (FIG. 59A) and % CBG produced (FIG. 59B)—of ORF2 mutants derived from breakdown of A09 triple mutant.
Figure 59B:
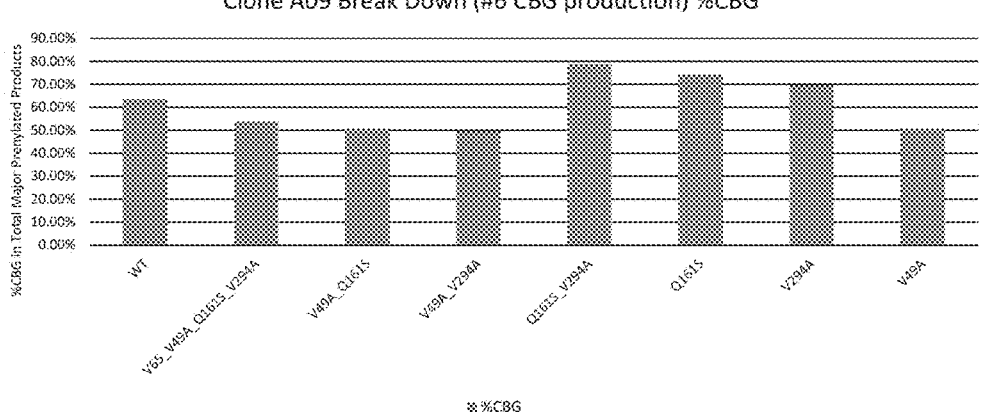
Figure 60A:
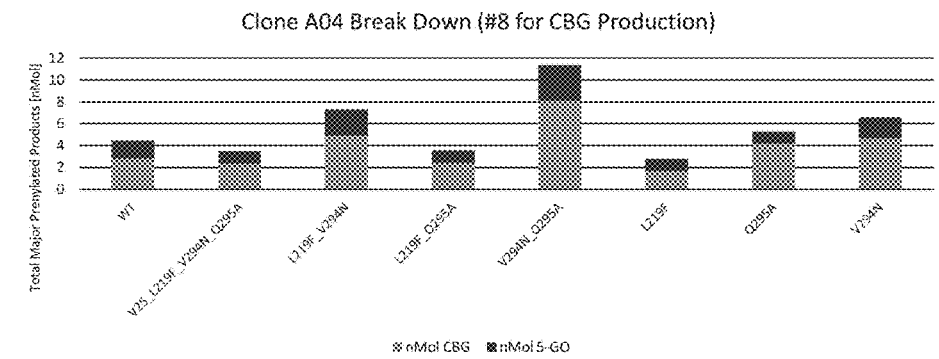
FIG. 60 shows the analysis of ORF2 enzymatic function (using O as substrate and GPP as donor)—including total nMol of prenylated products (FIG. 60A) and % CBG produced (FIG. 60B)—of ORF2 mutants derived from breakdown of A04 triple mutant.
Figure 60B:
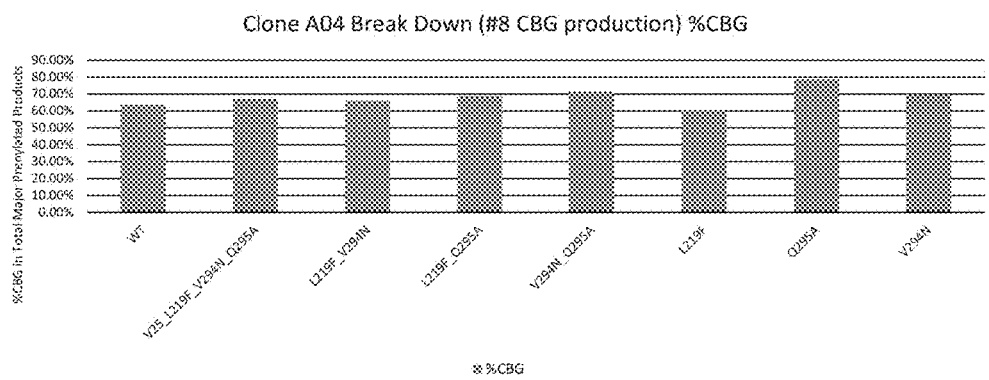
Figure 61A:
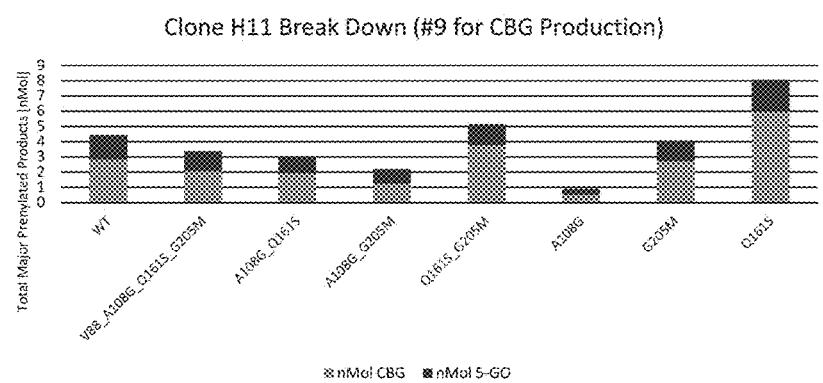
FIG. 61 shows the analysis of ORF2 enzymatic function (using O as substrate and GPP as donor)—including total nMol of prenylated products (FIG. 61A) and % CBG produced (FIG. 61B)—of ORF2 mutants derived from breakdown of H011 triple mutant.
Figure 61B:
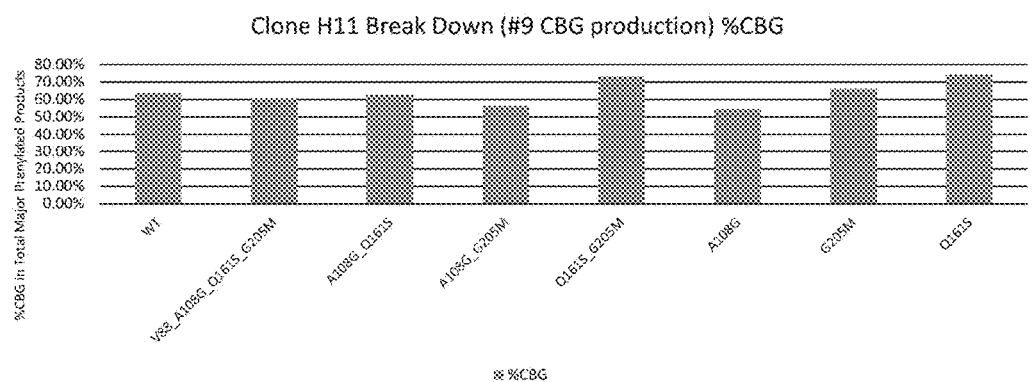
Figure 62A:
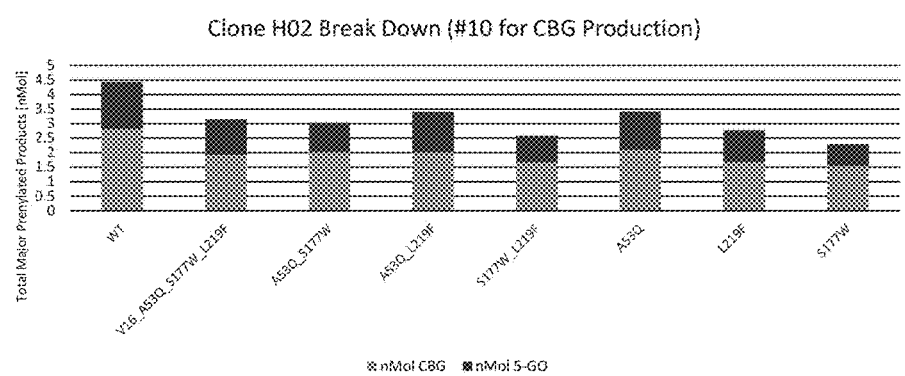
FIG. 62 shows the analysis of ORF2 enzymatic function (using O as substrate and GPP as donor)—including total nMol of prenylated products (FIG. 62A) and % CBG produced (FIG. 62B)—of ORF2 mutants derived from breakdown of H02 triple mutant.
Figure 62B:
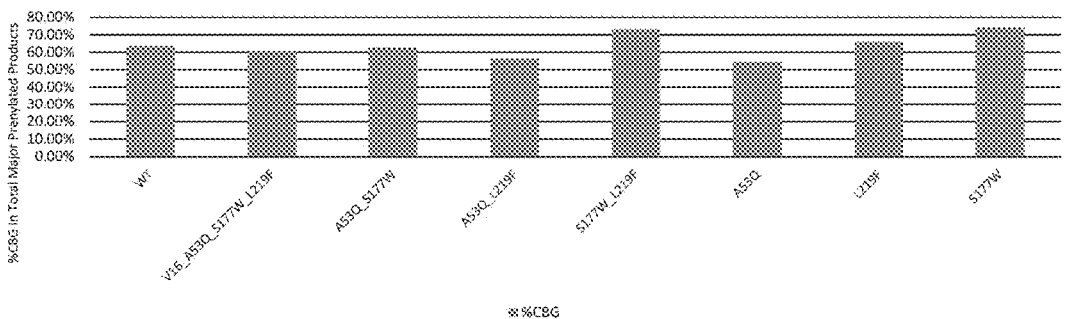
Figure 63A:
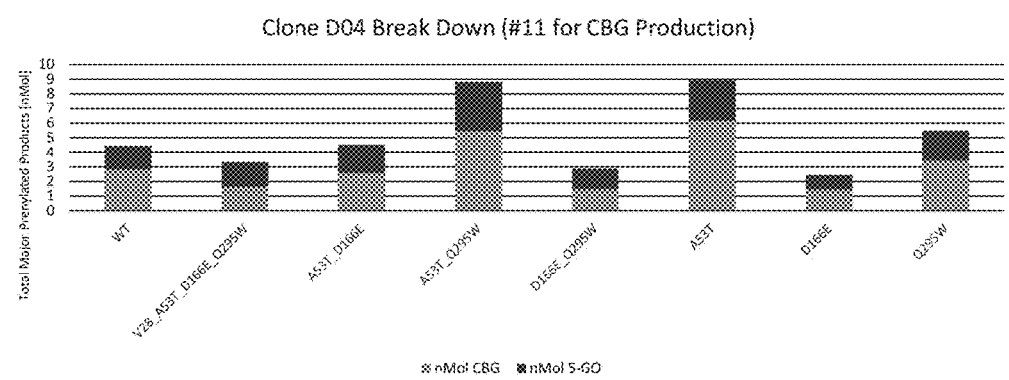
FIG. 63 shows the analysis of ORF2 enzymatic function (using O as substrate and GPP as donor)—including total nMol of prenylated products (FIG. 63A) and % CBG produced (FIG. 63B)—of ORF2 mutants derived from breakdown of D04 triple mutant.
Figure 63B:
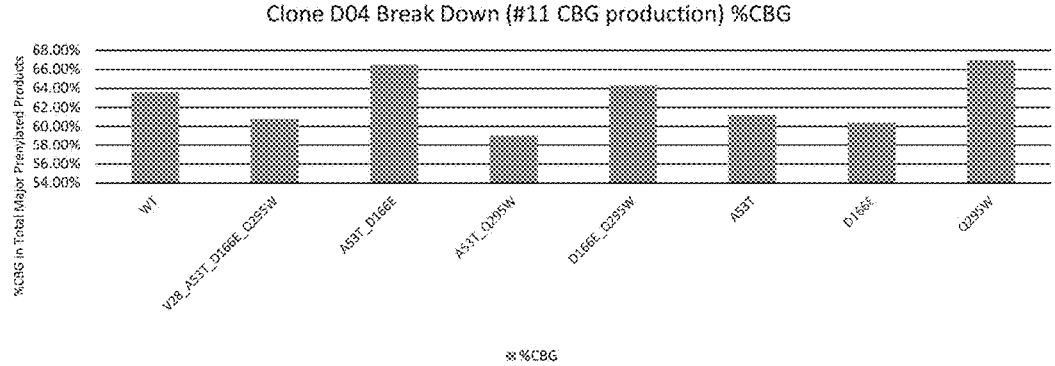
Figure 64A:
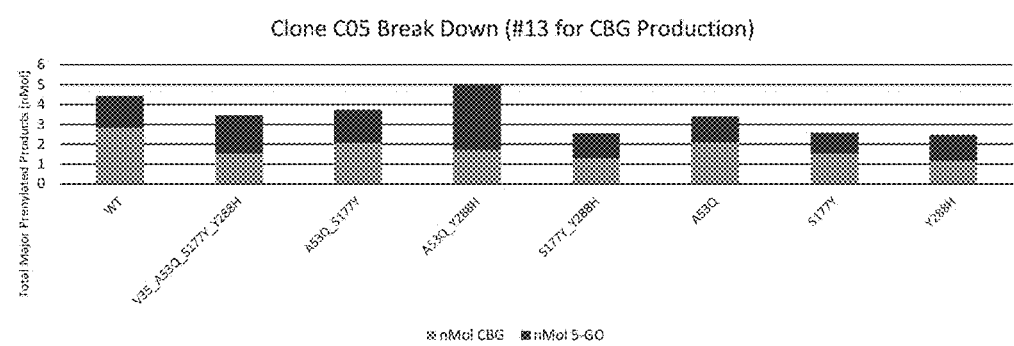
FIG. 64 shows the analysis of ORF2 enzymatic function (using O as substrate and GPP as donor)—including total nMol of prenylated products (FIG. 64A) and % CBG produced (FIG. 64B)—of ORF2 mutants derived from breakdown of C05 triple mutant.
Figure 64B:
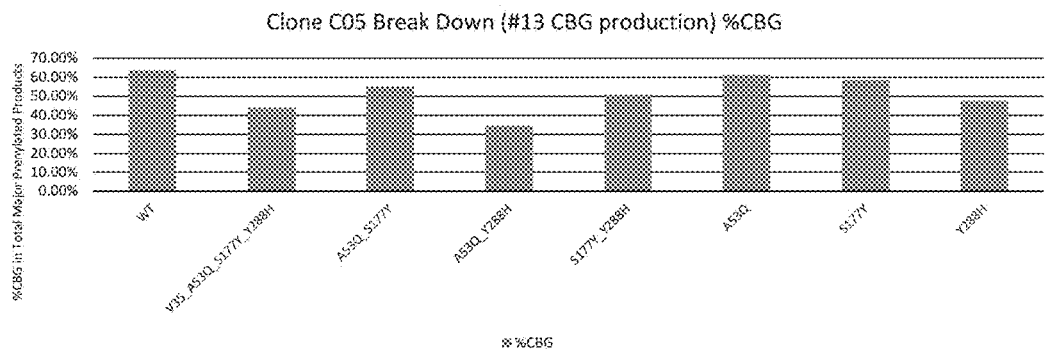
Figure 65A:
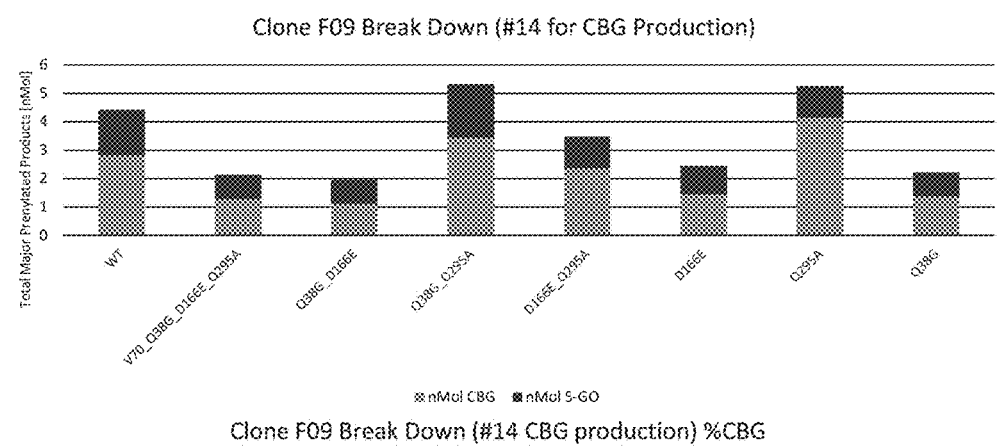
FIG. 65 shows the analysis of ORF2 enzymatic function (using O as substrate and GPP as donor)—including total nMol of prenylated products (FIG. 65A) and % CBG produced (FIG. 65B)—of ORF2 mutants derived from breakdown of F09 triple mutant.
Figure 65B:
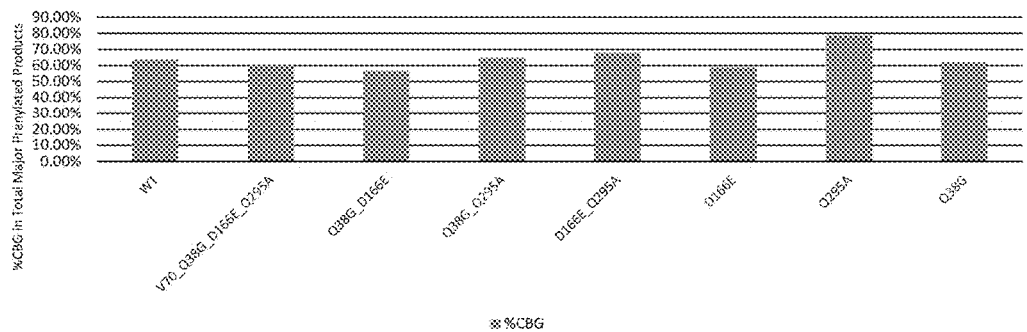
Figure 66A:
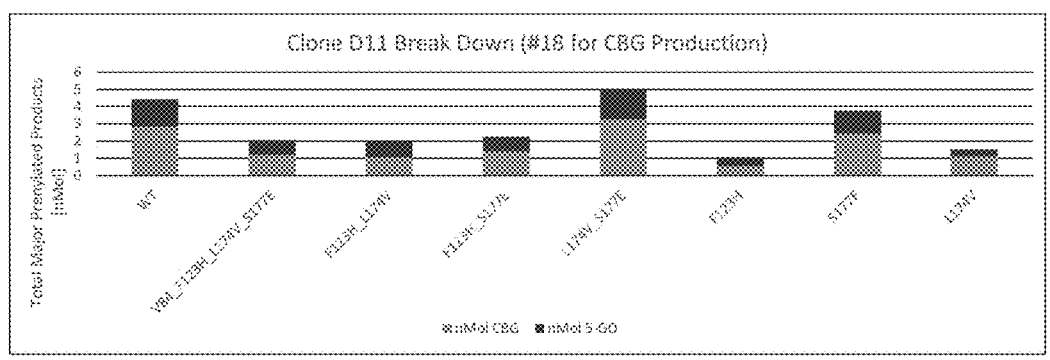
FIG. 66 shows the analysis of ORF2 enzymatic function (using O as substrate and GPP as donor)—including total nMol of prenylated products (FIG. 66A) and % CBG produced (FIG. 66B)—of ORF2 mutants derived from breakdown of D11 triple mutant.
Figure 66B:
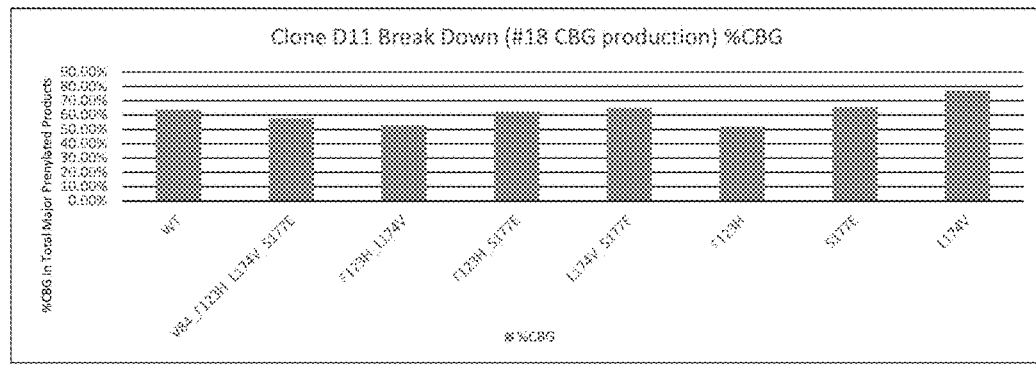
Figure 67A:
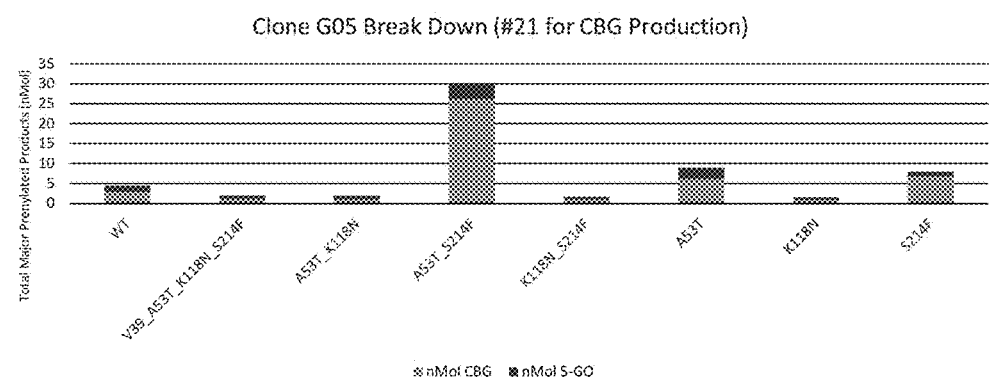
FIG. 67 shows the analysis of ORF2 enzymatic function (using O as substrate and GPP as donor)—including total nMol of prenylated products (FIG. 67A) and % CBG produced (FIG. 67B)—of ORF2 mutants derived from breakdown of G05 triple mutant.
Figure 67B:
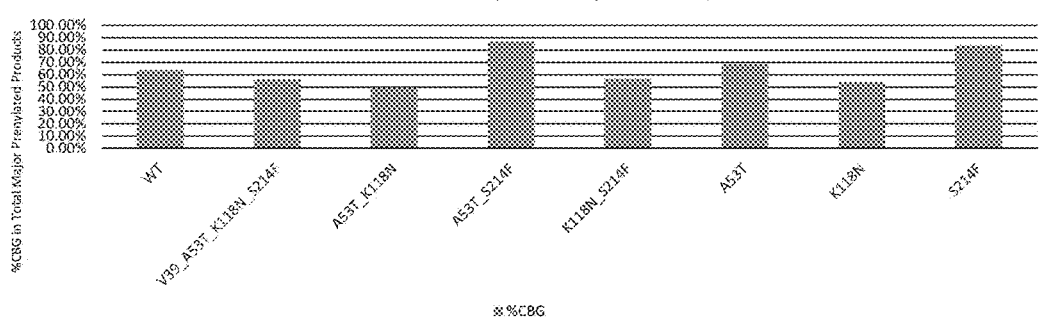
Figure 68A:
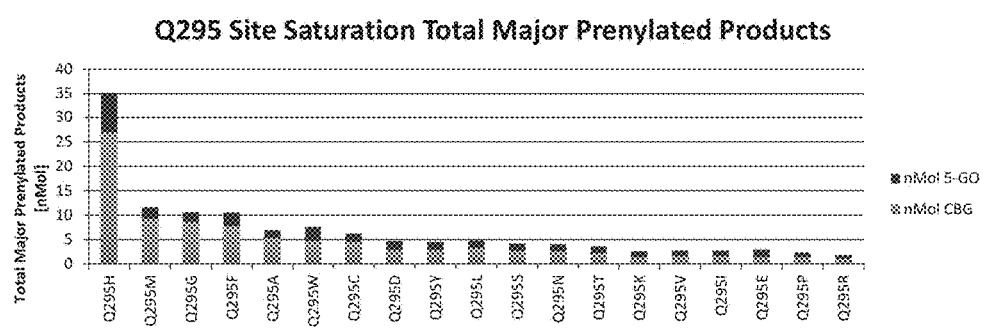
FIG. 68 shows the analysis of ORF2 enzymatic function (using O as substrate and GPP as donor)—including total nMol of prenylated products (FIG. 68A) and CBG production potential (FIG. 68B)—of ORF2 mutants carrying site saturation Q295 mutations.
Figure 68B:
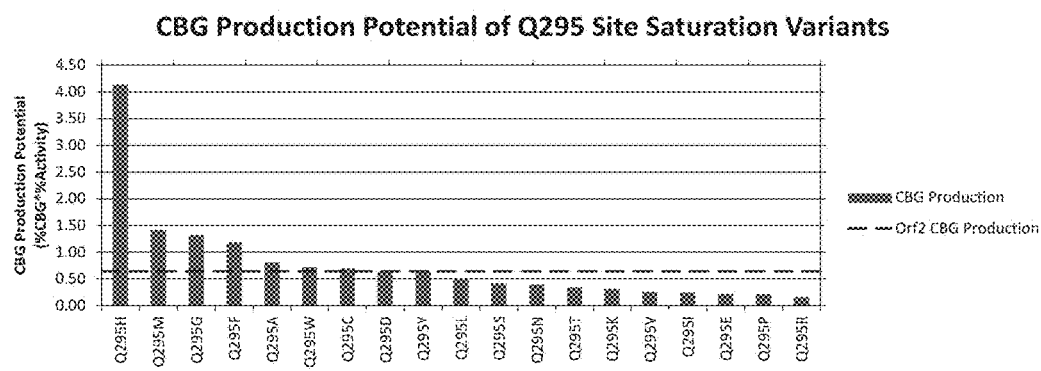
Figure 69:
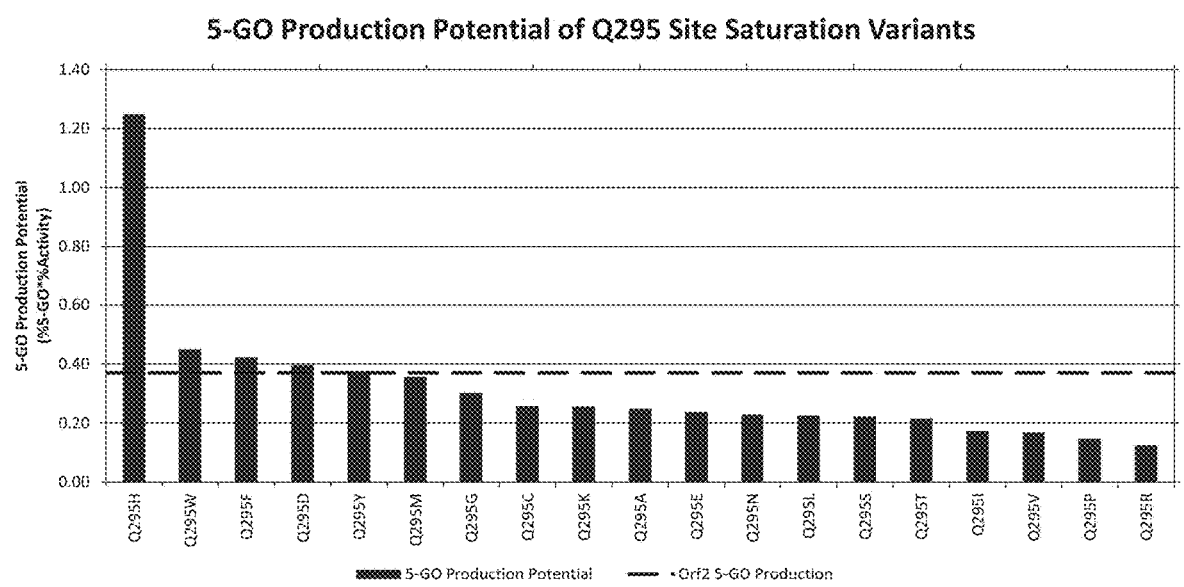
FIG. 69 shows 5-GO production potential (using O as substrate and GPP as donor) of ORF2 mutants carrying site saturation Q295 mutations.
Figure 70A:
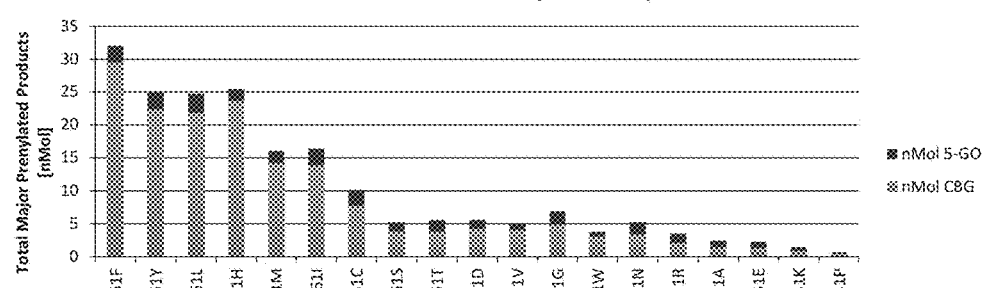
FIG. 70 shows the analysis of ORF2 enzymatic function (using O as substrate and GPP as donor)—including total nMol of prenylated products (FIG. 70A) and CBG production potential (FIG. 70B)—of ORF2 mutants carrying site saturation Q161 mutations.
Figure 70B:
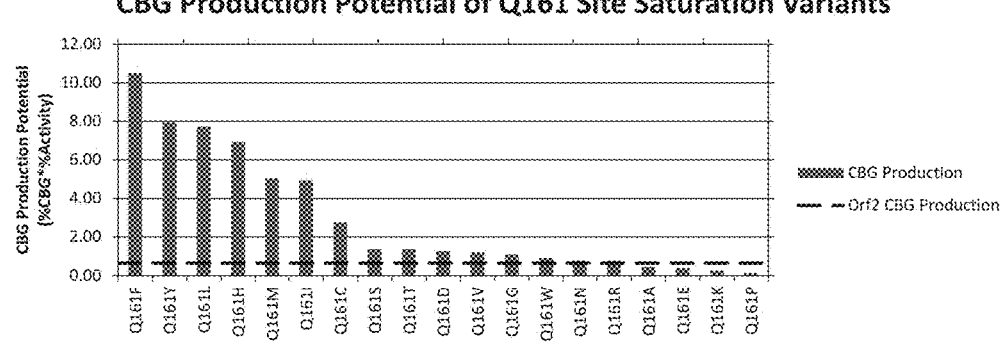
Figure 71:
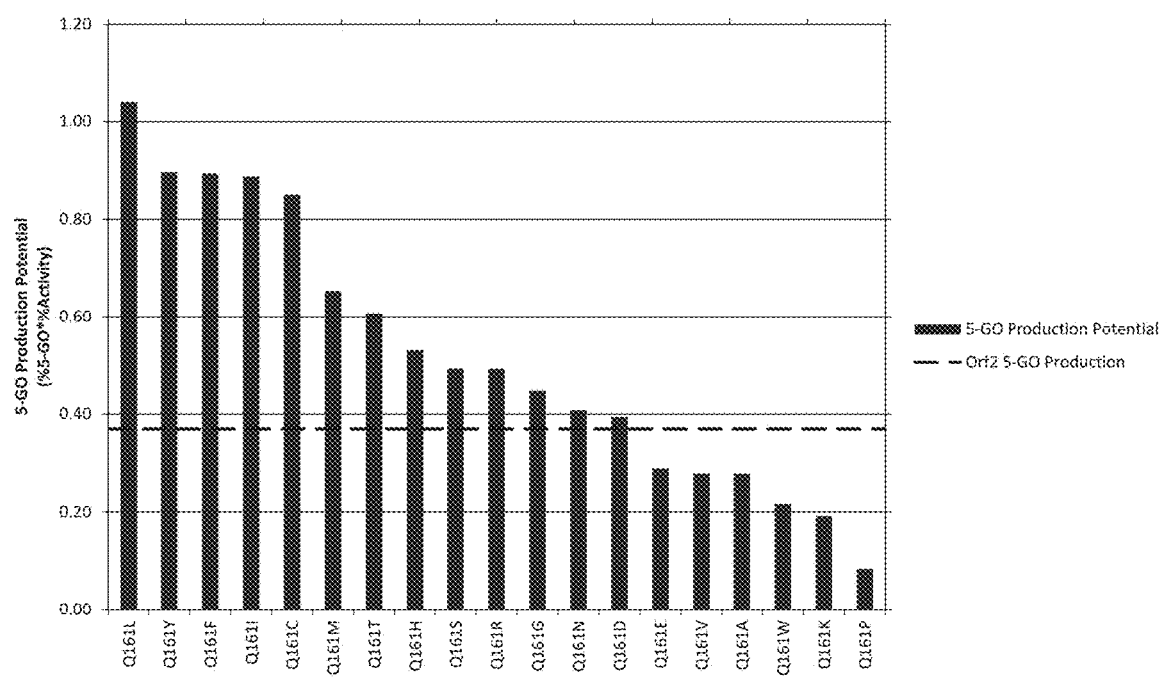
FIG. 71 shows 5-GO production potential (using O as substrate and GPP as donor) of ORF2 mutants carrying site saturation Q161 mutations.
Figure 72A:
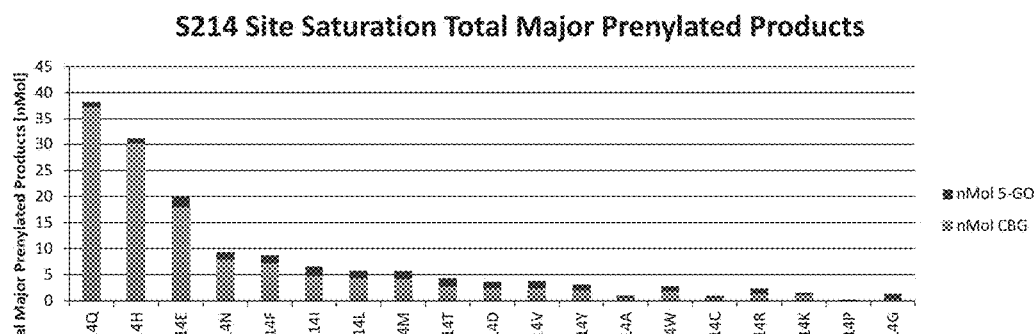
FIG. 72 shows the analysis of ORF2 enzymatic function (using O as substrate and GPP as donor)—including total nMol of prenylated products (FIG. 72A) and CBG production potential (FIG. 72B)—of ORF2 mutants carrying site saturation S214 mutations.
Figure 72B:
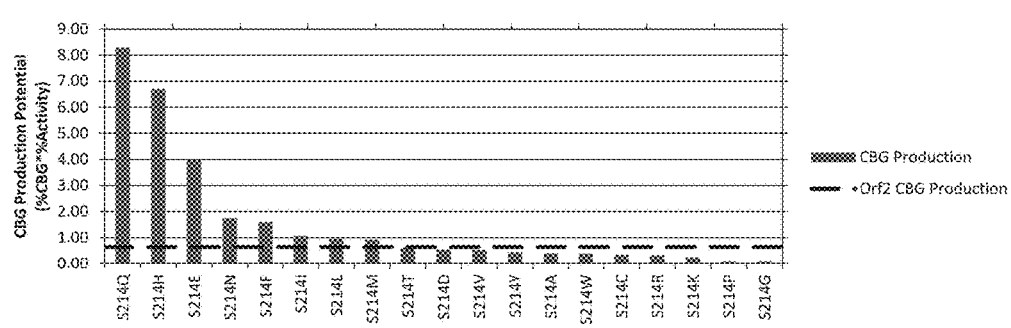
Figure 73:
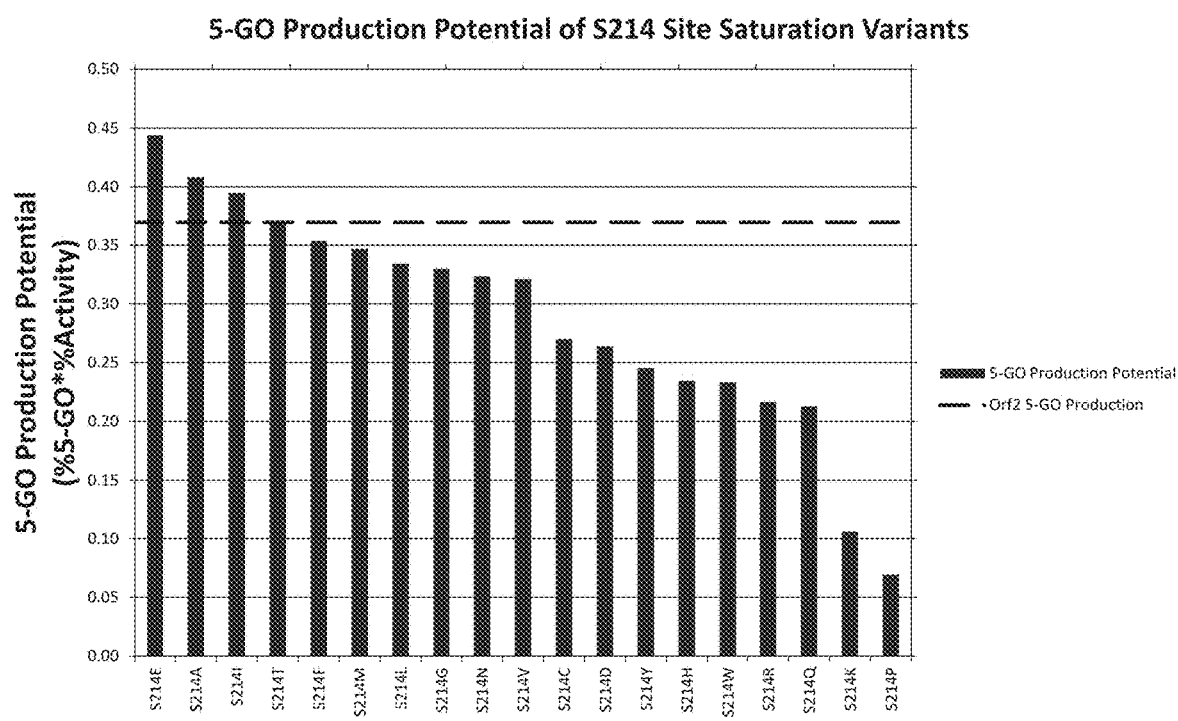
FIG. 73 shows 5-GO production potential (using O as substrate and GPP as donor) of ORF2 mutants carrying site saturation S214 mutations.

For the singleton and doubleton mutants resulting from the breakdown of triple mutants—E09; A09; A04; H11; H02; D04; C05; F09; D011; and G05—the total amount of prenylated products (and the respective proportion of CBG and 5-GO); and % CBG within the prenylated products was calculated. FIGS. 58-67 depict the total amount of prenylated products and % CBG produced using O as substrate and GPP as donor by the mutants derived from E09 (FIG. 58); A09 (FIG. 59); A04 (FIG. 60); H11 (FIG. 61); H02 (FIG. 62); D04 (FIG. 63); C05 (FIG. 64); F09 (FIG. 65); D011 (FIG. 66); and G05 (FIG. 67).

The breakdown analysis of the remaining triple mutants listed in Table 23 will be performed in a similar manner as described above; and the total amount of prenylated products and % CBG produced using O as substrate and GPP as donor by the mutants derived from this breakdown will be measured.

The breakdown analysis of triple mutants—E09; A09; A04; H11; H02; D04; C05; F09; D011; and G05—provided important insights into which positions on ORF2, when mutated, are likely to give rise to significant effects on the enzymatic activity of ORF2 in the reaction using Olivetol (O) as substrate and Geranyl pyrophosphate (GPP) as donor. Based on this analysis, the following amino acid sites were selected for targeted amino acid site saturation mutagenesis—Q16I, Q295, 5214, V294 M106, L174, A232, Y288 and M162. Site saturated mutagenesis was done for Q295, Q161, 5214 and Y288 by replacing the wild type residue with each of the other 19 standard amino acids. The amount of total prenylated products produced; CBG production potential; and 5-GO production potential were measured for Q295, Q161, 5214 and Y288 site saturated mutants, as depicted in FIGS. 68-73 and 99; and Tables 25-28.

TABLE 24

| RBP CLONE ID | Mutations | % CBG |
|---|---|---|
| A09 | V49A_Q161S_V294A | 53.74% |
| 022 | V49A_Q161S | 50.81% |
| 023 | V49A_V294A | 49.55% |
| 024 | Q161S_V294A | 78.91% |
| 041 | Q161S | 74.22% |
| 049 | V294A | 69.60% |
| 051 | V49A | 50.74% |
| H02 | A53Q_S177W_L219F | 60.79% |
| 007.1 | A53Q_S177W | 66.50% |
| 008 | A53Q_L219F | 59.04% |
| 009 | S177W_L219F | 64.31% |
| 032 | A53Q | 61.21% |
| 039.2 | L219F | 60.36% |
| 046 | S177W | 66.96% |
| C05 | A53Q_S177Y_Y288H | 43.91% |
| 019 | A53Q_S177Y | 55.17% |
| 020 | A53Q_Y288H | 34.48% |
| 021 | S177Y_Y288H | 50.77% |
| 032 | A53Q | 61.21% |
| 047.2 | S177Y | 58.45% |
| 052 | Y288H | 47.67% |
| E09 | A53T_M106E_Q161S | 77.61% |
| 025 | A53T_M106E | 66.34% |
| 026 | A53T_Q161S | 77.30% |
| 027 | M106E_Q161S | 70.34% |
| 033 | A53T | 68.57% |
| 040 | M106E | 63.55% |
| 041 | Q161S | 74.22% |
| D04 | A53T_D166E_Q295W | 49.68% |
| 016 | A53T_D166E | 57.26% |
| 017 | A53T_Q295W | 61.37% |
| 018 | D166E_Q295W | 51.62% |
| 033 | A53T | 68.57% |
| 034 | D166E | 58.61% |
| 043 | Q295W | 62.63% |
| H11 | A108G_Q161S_G205M | 60.55% |
| 010 | A108G_Q161S | 62.73% |
| 011 | A108G_G205M | 56.30% |
| 012 | Q161S_G205M | 73.18% |
| 031 | A108G | 54.52% |
| 036 | G205M | 66.08% |
| 041 | Q161S | 74.22% |
| A04 | L219F_V294N_Q295A | 67.09% |
| 004 | L219F_V294N | 65.97% |
| 005.1 | L219F_Q295A | 68.82% |
| 006 | V294N_Q295A | 71.52% |

TABLE 24-continued

| RBP CLONE ID | Mutations | % CBG |
|---|---|---|
| 039.2 | L219F | 60.36% |
| 042 | Q295A | 78.68% |
| 050 | V294N | 69.86% |
| G05 | A53T_K118N_S214F | 56.27% |
| 028 | A53T_K118N | 49.61% |
| 029.1 | A53T_S214F | 86.94% |
| 030 | K118N_S214F | 56.78% |
| 033 | A53T | 68.57% |
| 037 | K118N | 54.10% |
| 048 | S214F | 83.66% |
| F09 | Q38G_D166E_Q295A | 60.04% |
| 001 | Q38G_D166E | 56.62% |
| 002 | Q38G_Q295A | 64.68% |
| 003 | D166E_Q295A | 67.90% |
| 034 | D166E | 58.61% |
| 042 | Q295A | 78.68% |
| 044 | Q38G | 61.84% |
| D11 | F123H_L174V_S177E | 57.73% |
| 013 | F123H_L174V | 52.69% |
| 014 | F123H_S177E | 62.24% |
| 015 | L174V_S177E | 64.87% |
| 035 | F123H | 52.03% |
| 045 | S177E | 65.38% |
| 038 | L174V | 77.09% |
| G12 | A17T_Q161W_A232S | 77.37% |
| q423-1 | A17T | 68.98% |
| EE09 | Q161W | 80.71% |
| q424-5 | A232S | 78.59% |
| C06 | Q161A_M162F_Q295A | 77.88% |
| DD01 | Q161A | 61.26% |
| 431-1 | M162F | 80.78% |
| 042 | Q295A | 76.50% |

TABLE 25

Q295 site saturated mutants

| Mutations | nMol CBG | nMol 5-GO | Total nMol Products | % CBG | % Activity | CBG Production | % 5-GO | 5-GO Production Potential |
|---|---|---|---|---|---|---|---|---|
| Q295H | 26.97874949 | 8.154443771 | 35.13319326 | 76.79% | 538.04% | 4.13 | 23.21% | 1.25 |
| Q295W | 4.693502248 | 2.936800926 | 7.630303173 | 61.51% | 116.85% | 0.72 | 38.49% | 0.45 |
| Q295F | 7.742541888 | 2.762962147 | 10.50550403 | 73.70% | 160.88% | 1.19 | 26.30% | 0.42 |
| Q295D | 2.895790764 | 1.784120337 | 4.679911101 | 61.88% | 104.13% | 0.64 | 38.12% | 0.40 |
| Q295Y | 2.872496935 | 1.689349275 | 4.56184621 | 62.97% | 101.50% | 0.64 | 37.03% | 0.38 |
| Q295M | 9.265631385 | 2.323819494 | 11.58945088 | 79.95% | 177.48% | 1.42 | 20.05% | 0.36 |
| Q295G | 8.638741316 | 1.972009477 | 10.61075079 | 81.41% | 162.50% | 1.32 | 18.59% | 0.30 |
| Q295C | 4.541070699 | 1.682737341 | 6.22380804 | 72.96% | 95.31% | 0.70 | 27.04% | 0.26 |
| Q295K | 1.421332244 | 1.151578599 | 2.572910843 | 55.24% | 57.25% | 0.32 | 44.76% | 0.26 |
| Q295A | 5.303228443 | 1.62929087 | 6.932519313 | 76.50% | 106.17% | 0.81 | 23.50% | 0.25 |
| Q295E | 1.424192889 | 1.546917186 | 2.971110075 | 47.93% | 45.50% | 0.22 | 52.07% | 0.24 |
| Q295N | 2.542705353 | 1.496225687 | 4.038931041 | 62.95% | 61.85% | 0.39 | 37.05% | 0.23 |
| Q295L | 3.336738864 | 1.470879938 | 4.807618802 | 69.41% | 73.63% | 0.51 | 30.59% | 0.23 |
| Q295S | 2.729055987 | 1.451044135 | 4.180100122 | 65.29% | 64.02% | 0.42 | 34.71% | 0.22 |
| Q295T | 2.208418472 | 1.404209598 | 3.61262807 | 61.13% | 55.32% | 0.34 | 38.87% | 0.22 |
| Q295I | 1.582345729 | 1.128712326 | 2.711058055 | 58.37% | 41.52% | 0.24 | 41.63% | 0.17 |
| Q295V | 1.653044544 | 1.101162598 | 2.754207143 | 60.02% | 42.18% | 0.25 | 39.98% | 0.17 |
| Q295P | 1.404168369 | 0.95652653 | 2.3606949 | 59.48% | 36.15% | 0.22 | 40.52% | 0.15 |
| Q295R | 1.035962403 | 0.816573916 | 1.852536319 | 55.92% | 28.37% | 0.16 | 44.08% | 0.13 |

TABLE 26

Q161 site saturated mutants

| Mutations | nMol CBG | nMol 5-GO | Total nMol Products | % CBG | % Activity | CBG Production | % 5-GO | 5-GO Production Potential |
|---|---|---|---|---|---|---|---|---|
| Q161L | 21.77482632 | 2.927158521 | 24.70198484 | 88.15% | 877.78% | 7.74 | 11.85% | 1.04 |
| Q161Y | 22.34164283 | 2.522728525 | 24.86437135 | 89.85% | 883.55% | 7.94 | 10.15% | 0.90 |
| Q161F | 29.53739273 | 2.514739104 | 32.05213183 | 92.15% | 1138.97% | 10.50 | 7.85% | 0.89 |
| Q161I | 13.8998774 | 2.498209268 | 16.39808667 | 84.77% | 582.70% | 4.94 | 15.23% | 0.89 |
| Q161C | 7.722108705 | 2.393244807 | 10.11535351 | 76.34% | 359.45% | 2.74 | 23.66% | 0.85 |
| Q161M | 14.18716796 | 1.838944294 | 16.02611226 | 88.53% | 569.49% | 5.04 | 11.47% | 0.65 |
| Q161T | 3.827135268 | 1.707256598 | 5.534391866 | 69.15% | 196.66% | 1.36 | 30.85% | 0.61 |
| Q161H | 23.62729873 | 1.806711114 | 25.43400985 | 92.90% | 747.62% | 6.95 | 7.10% | 0.53 |
| Q161S | 3.836534532 | 1.387679762 | 5.224214294 | 73.44% | 185.64% | 1.36 | 26.56% | 0.49 |
| Q161R | 2.120147119 | 1.386026778 | 3.506173897 | 60.47% | 124.59% | 0.75 | 39.53% | 0.49 |
| Q161G | 4.908868002 | 2.01416056 | 6.923028561 | 70.91% | 154.03% | 1.09 | 29.09% | 0.45 |
| Q161N | 3.405803024 | 1.832883354 | 5.238686379 | 65.01% | 116.56% | 0.76 | 34.99% | 0.41 |
| Q161D | 4.249693502 | 1.342222019 | 5.591916214 | 76.00% | 164.37% | 1.25 | 24.00% | 0.39 |
| Q161A | 1.49448304 | 0.944955645 | 2.439438685 | 61.26% | 71.71% | 0.44 | 38.74% | 0.28 |
| Q161W | 3.075194115 | 0.734751226 | 3.809945341 | 80.71% | 111.99% | 0.90 | 19.29% | 0.22 |
| Q161K | 0.852472415 | 0.651826547 | 1.504298962 | 56.67% | 44.22% | 0.25 | 43.33% | 0.19 |
| Q161P | 0.434818145 | 0.281558213 | 0.716376357 | 60.70% | 21.06% | 0.13 | 39.30% | 0.08 |

TABLE 27

S214 site saturated mutants

| Mutations | nMol CBG | nMol 5-GO | Total nMol Products | % CBG | % Activity | CBG Production potential | % 5-GO | 5-GO Production Potential |
|---|---|---|---|---|---|---|---|---|
| S214E | 17.95218635 | 1.994600253 | 19.9467866 | 90.00% | 443.81% | 3.99 | 10.00% | 0.44 |
| S214A | 0.523089497 | 0.539974654 | 1.063064152 | 49.21% | 0.8036911 | 0.40 | 0.507942 | 0.41 |
| S214I | 4.800980793 | 1.774477933 | 6.575458725 | 73.01% | 146.30% | 1.07 | 26.99% | 0.39 |
| S214T | 2.703310176 | 1.657391592 | 4.360701768 | 61.99% | 97.02% | 0.60 | 38.01% | 0.37 |
| S214F | 7.143849612 | 1.589343765 | 8.733193377 | 81.80% | 194.31% | 1.59 | 18.20% | 0.35 |
| S214M | 4.120147119 | 1.558763568 | 5.678910687 | 72.55% | 126.35% | 0.92 | 27.45% | 0.35 |
| S214L | 4.30404577 | 1.502286627 | 5.806332398 | 74.13% | 129.19% | 0.96 | 25.87% | 0.33 |
| S214G | 0.209235799 | 1.126783845 | 1.336019644 | 15.66% | 0.3912208 | 0.06 | 0.843389 | 0.33 |
| S214N | 7.877400899 | 1.45352361 | 9.330924509 | 84.42% | 207.61% | 1.75 | 15.58% | 0.32 |
| S214V | 2.365753984 | 1.443054714 | 3.808808698 | 62.11% | 84.74% | 0.53 | 37.89% | 0.32 |
| S214C | 0.537801389 | 0.420684335 | 0.958485725 | 56.11% | 0.6153359 | 0.35 | 0.438905 | 0.27 |
| S214D | 2.427870862 | 1.186566753 | 3.614437615 | 67.17% | 80.42% | 0.54 | 32.83% | 0.26 |
| S214Y | 1.990192072 | 1.103366577 | 3.093558649 | 64.33% | 68.83% | 0.44 | 35.67% | 0.25 |
| S214H | 30.08377605 | 1.054052565 | 31.13782862 | 96.61% | 692.81% | 6.69 | 3.39% | 0.23 |
| S214W | 1.735594606 | 1.049093614 | 2.78468822 | 62.33% | 61.96% | 0.39 | 37.67% | 0.23 |
| S214R | 1.420514916 | 0.974158356 | 2.394673272 | 59.32% | 53.28% | 0.32 | 40.68% | 0.22 |
| S214Q | 37.24560687 | 0.955975536 | 38.2015824 | 97.50% | 849.97% | 8.29 | 0.025025 | 0.21 |
| S214K | 1.095218635 | 0.475508292 | 1.570726928 | 69.73% | 34.95% | 0.24 | 30.27% | 0.11 |
| S214P | 0.102983245 | 0.107719434 | 0.210702678 | 48.88% | 0.1352685 | 0.07 | 0.511239 | 0.07 |

TABLE 28

Y288 site saturated mutants

| Mutations | nMol CBG | nMol 5-GO | Total nMol Products | % CBG | % Activity | CBG Production | % 5-GOA | 5-GOA Production |
|---|---|---|---|---|---|---|---|---|
| Y288F | 16.59256232 | 2.590225357 | 19.18278768 | 86.50% | 561.72% | 4.86 | 13.50% | 0.75848 |
| Y288L | 13.88516551 | 1.489338256 | 15.37450376 | 90.31% | 450.20% | 4.07 | 9.69% | 0.43612 |
| Y288I | 9.454025337 | 1.173342884 | 10.62736492 | 88.96% | 311.20% | 2.77 | 11.04% | 0.34358 |
| Y288M | 7.780956273 | 1.176924348 | 8.957880621 | 86.86% | 262.31% | 2.28 | 13.14% | 0.34463 |
| Y288T | 5.373518594 | 0.684059728 | 6.057578322 | 88.71% | 177.38% | 1.57 | 11.29% | 0.20031 |
| Y288C | 5.008990601 | 0.566146895 | 5.575137496 | 89.85% | 163.25% | 1.47 | 10.15% | 0.16578 |
| Y288A | 4.105435227 | 0.304148989 | 4.409584216 | 93.10% | 129.12% | 1.20 | 6.90% | 0.08906 |
| Y288W | 2.646505926 | 0.507741473 | 3.154247399 | 83.90% | 92.36% | 0.77 | 16.10% | 0.14868 |
| Y288P | 5.30731508 | 0.655683509 | 5.962998588 | 89.00% | 174.61% | 0.40 | 11.00% | 0.192 |
| Y288N | 0.82958725 | 0.542729627 | 1.372316877 | 60.45% | 40.18% | 0.24 | 39.55% | 0.15893 |
| Y288S | 0.549243972 | 0.158135434 | 0.707379407 | 77.64% | 20.71% | 0.16 | 22.36% | 0.04631 |
| Y288G | 0.398038414 | 0.08788363 | 0.485922044 | 81.91% | 14.23% | 0.12 | 18.09% | 0.02573 |
| Y288H | 0.305271761 | 0.648245082 | 0.953516844 | 32.02% | 27.92% | 0.09 | 67.98% | 0.18982 |
| Y288K | 0.136493666 | 0.107994931 | 0.244488597 | 55.83% | 7.16% | 0.04 | 44.17% | 0.03162 |
| Y288D | 0.097261953 | 0.073557772 | 0.170819725 | 56.94% | 5.00% | 0.03 | 43.06% | 0.02154 |
| Y288E | 0.073968124 | 0.076312745 | 0.150280869 | 49.22% | 4.40% | 0.02 | 50.78% | 0.02235 |
| Y288R | 0.035553739 | 0.013223869 | 0.048777608 | 72.89% | 1.43% | 0.01 | 27.11% | 0.00387 |

Similarly, site saturated mutagenesis will also be completed for M106, and V294; and the amount of total prenylated products produced; CBG production potential; and 5-GO production potential will be measured for each of these site saturated mutants.

From the results described above, multiple mutations of Q295, Q161 and S214 that have significantly higher CBG or 5-GO production potential; and/or higher amount of prenylated products, as compared to WT ORF2, were identified. Thus, the ORF2 mutants disclosed herein have unexpectedly superior enzymatic functions, in a reaction using O as a substrate and GPP as donor, as compared to WT ORF2.

Figure 74:
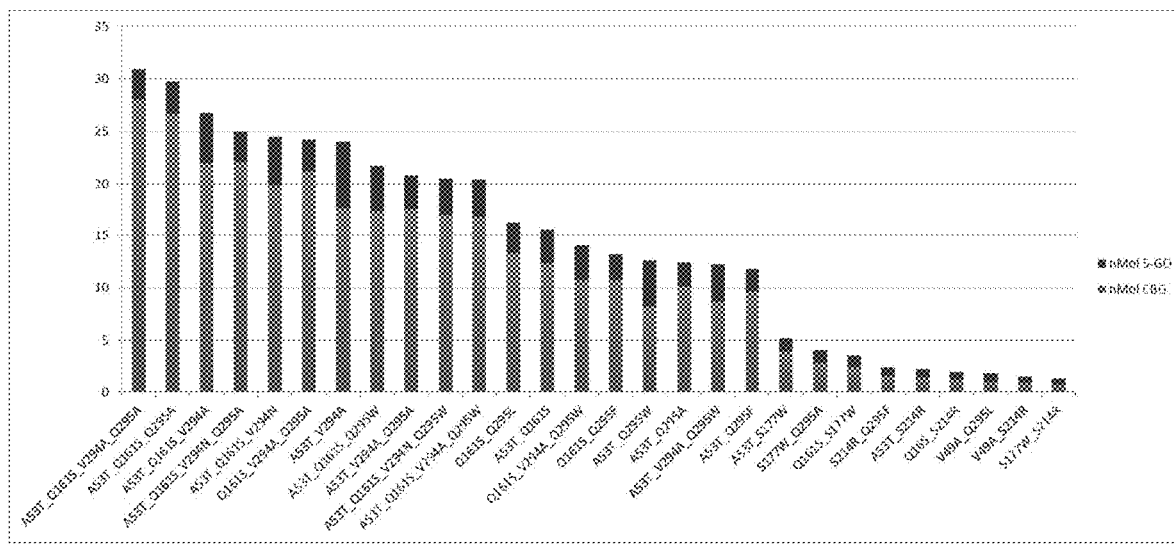
FIG. 74 shows the total nMol of prenylated products produced (using O as substrate and GPP as donor) by ORF2 stacking mutants.
Figure 75:
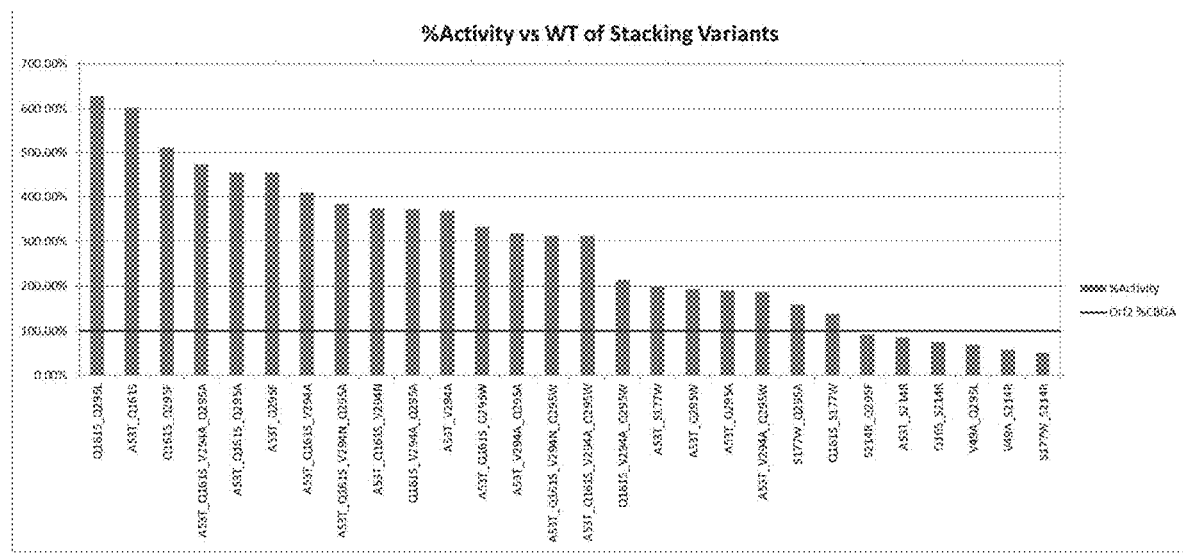
FIG. 75 shows the % enzymatic activity (using O as substrate and GPP as donor) of ORF2 stacking mutants.
Figure 76:
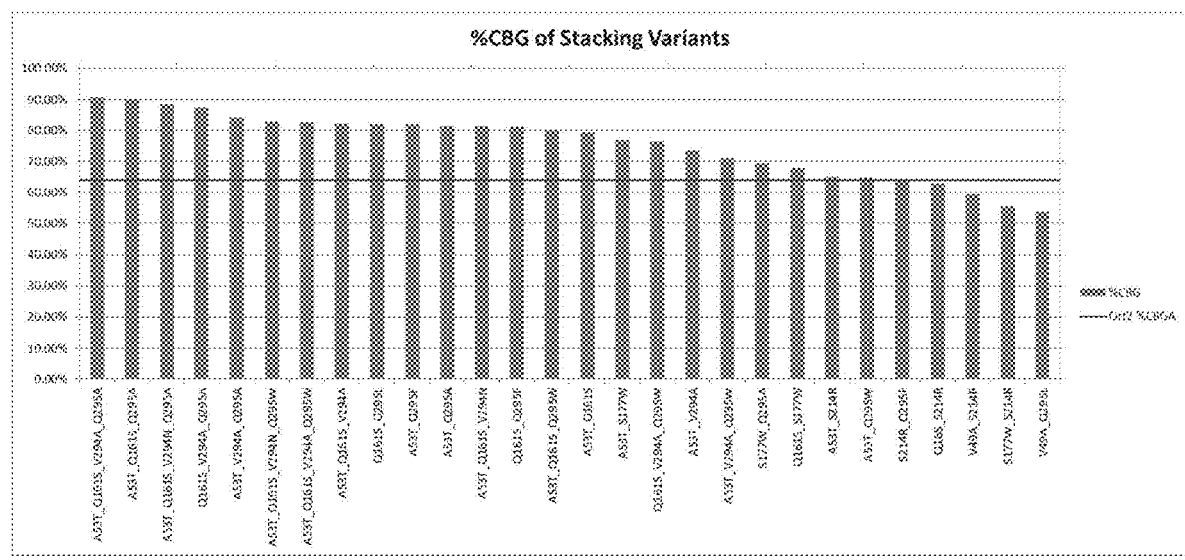
FIG. 76 shows the % CBG produced (using O as substrate and GPP as donor) by ORF2 stacking mutants.
Figure 77:
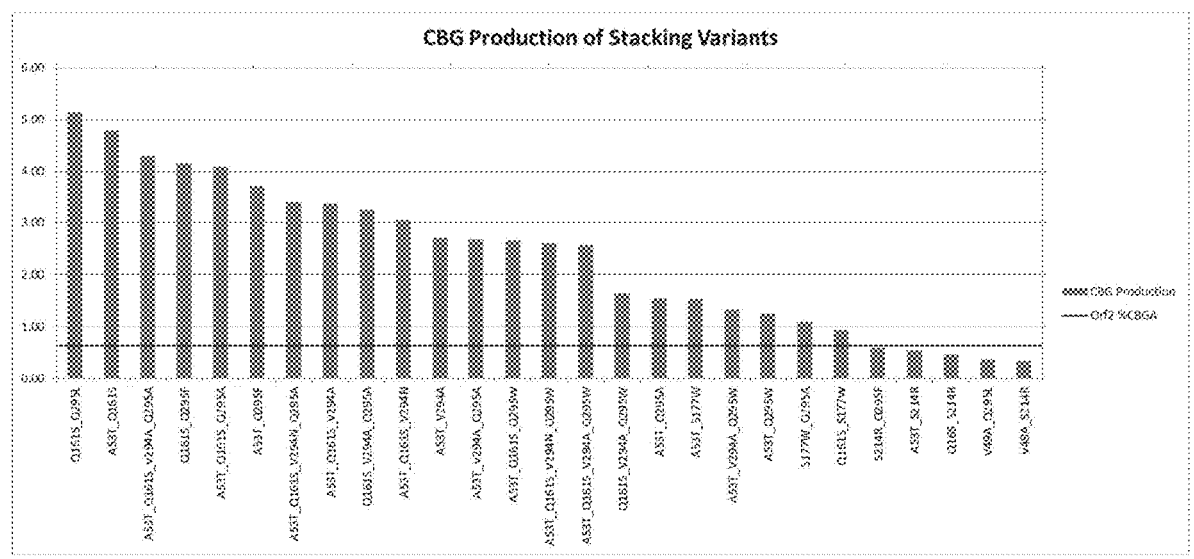
FIG. 77 shows the CBG production potential (using O as substrate and GPP as donor) of ORF2 stacking mutants.

Finally, ORF2 stacking mutants, which carry different novel combinations of the mutations that our analysis identified as being important for ORF2's enzymatic activity were analyzed to determine the total amount of prenylated products produced by each of the stacking mutants (FIG. 74); % enzymatic activity (FIG. 75); % CBG produced (FIG. 76); and CBG production potential (FIG. 77). Table 29 provides a summary of the enzymatic function, using O as substrate and GPP as donor, for each of the stacking mutants. The analysis of the stacking mutants shows that multiple stacking mutants have significantly higher % enzymatic activity, % CBG, and CBG production potential, compared to the WT ORF2, thereby indicating that the ORF2 stacking mutants disclosed herein have synergistically enhanced effects compared to the individual single mutants. Thus, the ORF2 stacking mutants disclosed herein have unexpectedly superior enzymatic functions, in a reaction using O and GPP, as compared to WT ORF2.

For instance, ORF2 double mutants, Q161S-Q295L; A53T-Q161S; A53 T-V294A; Q161S-Q295F; and A53T-Q295F have synergistically enhanced CBGVA production potential and % activity as compared to either of the single mutants. See FIGS. 92-96.

In the future, more stacking mutants will be generated as described above, based on the breakdown analysis of remaining triple mutants listed in Table 10, and planned site saturation mutagenesis experiments described above. These stacking mutants will further be analyzed to determine their % enzymatic activity, % CBG, %5-GO and CBG production potential.

TABLE 29

| Mutations | CBG (7.095) | 5GO (7.745) | nMol CBG | nMol 5-GO | Total nMol Products | % CBG | % Activity | CBG Production |
|---|---|---|---|---|---|---|---|---|
| Q161S_Q295L | 3.2538 | 1.0628 | 13.29709849 | 2.927985013 | 16.2250835 | 81.95% | 628.43% | 5.15 |
| A53T_Q161S | 3.0213 | 1.1637 | 12.34695546 | 3.205961761 | 15.55291722 | 79.39% | 602.39% | 4.78 |
| A53T_Q161S_V294A_Q295A | 6.8655 | 1.0392 | 28.05680425 | 2.862967657 | 30.91977191 | 90.74% | 473.51% | 4.30 |
| Q161S_Q295F | 2.6242 | 0.9004 | 10.72415202 | 2.480577442 | 13.20472947 | 81.21% | 511.44% | 4.15 |
| A53T_Q161S_Q295A | 6.5383 | 1.0823 | 26.71965672 | 2.981706981 | 29.7013637 | 89.96% | 454.86% | 4.09 |
| A53T_Q295F | 2.3515 | 0.773 | 9.609726195 | 2.129593917 | 11.73932011 | 81.86% | 454.69% | 3.72 |
| A53T_Q161S_V294N_Q295A | 5.4091 | 1.0492 | 22.10502656 | 2.890517384 | 24.99554395 | 88.44% | 382.79% | 3.39 |
| A53T_Q161S_V294A | 5.3751 | 1.7353 | 21.96608092 | 4.780704171 | 26.74678509 | 82.13% | 409.61% | 3.36 |
| Q161S_V294A_Q295A | 5.1846 | 1.1046 | 21.18757662 | 3.043142873 | 24.2307195 | 87.44% | 371.08% | 3.24 |
| A53T_Q161S_V294N | 4.8641 | 1.667 | 19.87780956 | 4.592539534 | 24.4703491 | 81.23% | 374.75% | 3.04 |
| A53T_V294A | 4.3154 | 2.3259 | 17.63547201 | 6.407791063 | 24.04326307 | 73.35% | 368.21% | 2.70 |
| A53T_V294A_Q295A | 4.2878 | 1.2019 | 17.52268083 | 3.311201719 | 20.83388255 | 84.11% | 319.06% | 2.68 |
| A53T_Q161S_Q295W | 4.2451 | 1.5899 | 17.34818145 | 4.380131137 | 21.72831258 | 79.84% | 332.75% | 2.66 |
| A53T_Q161S_V294N_Q295W | 4.1445 | 1.2834 | 16.93706579 | 3.535731996 | 20.47279779 | 82.73% | 313.53% | 2.59 |
| A53T_Q161S_V294A_Q295W | 4.1157 | 1.3136 | 16.81937066 | 3.618932173 | 20.43830283 | 82.29% | 313.00% | 2.58 |
| Q161S_V294A_Q295W | 2.6247 | 1.1964 | 10.72619534 | 3.296049369 | 14.02224471 | 76.49% | 214.74% | 1.64 |
| A53T_Q295A | 2.4689 | 0.8374 | 10.08949734 | 2.307014161 | 12.3965115 | 81.39% | 189.84% | 1.55 |
| A53T_S177W | 0.9678 | 0.4316 | 3.955046996 | 1.189046228 | 5.144093225 | 76.89% | 199.24% | 1.53 |
| A53T_V294A_Q295W | 2.1217 | 1.2914 | 8.670617082 | 3.557771778 | 12.22838886 | 70.91% | 187.27% | 1.33 |
| A53T_Q295W | 2.0002 | 1.6157 | 8.174090723 | 4.451209433 | 12.62530016 | 64.74% | 193.35% | 1.25 |
| S177W_Q295A | 0.694 | 0.4575 | 2.836125868 | 1.260400022 | 4.09652589 | 69.23% | 158.67% | 1.10 |
| Q161S_S177W | 0.5912 | 0.4139 | 2.416019616 | 1.140283211 | 3.556302827 | 67.94% | 137.74% | 0.94 |
| S214R_Q295F | 0.371 | 0.309 | 1.516142215 | 0.851286572 | 2.367428787 | 64.04% | 91.69% | 0.59 |
| A53T_S214R | 0.3473 | 0.2767 | 1.419288925 | 0.762300953 | 2.181589878 | 65.06% | 84.50% | 0.55 |
| Q16S_S214R | 0.2947 | 0.2578 | 1.204331835 | 0.710231969 | 1.914563804 | 62.90% | 74.15% | 0.47 |
| V49A_Q295L | 0.2342 | 0.2992 | 0.957090315 | 0.82428784 | 1.781378154 | 53.73% | 69.00% | 0.37 |
| V49A_S214R | 0.2154 | 0.2196 | 0.880261545 | 0.604992011 | 1.485253555 | 59.27% | 57.53% | 0.34 |
| S177W_S214R | 0.1776 | 0.2114 | 0.725786678 | 0.582401234 | 1.308187912 | 55.48% | 50.67% | 0.28 |

Figure 78:
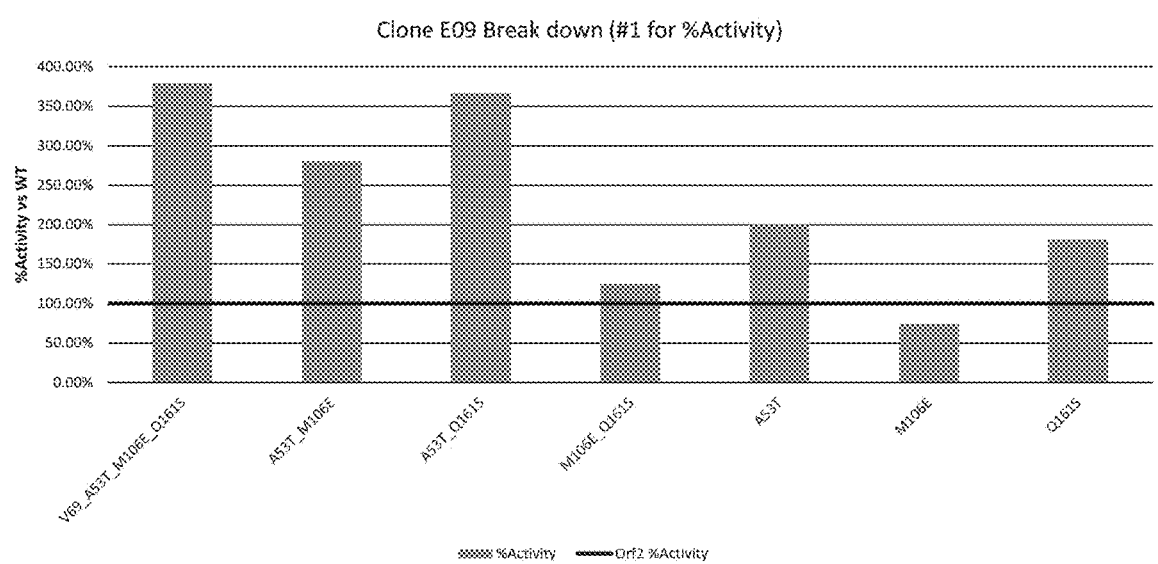
FIG. 78 shows % activity (using O as substrate and GPP as donor) of ORF2 mutants resulting from breakdown of tripe mutant clone E09.
Figure 79:
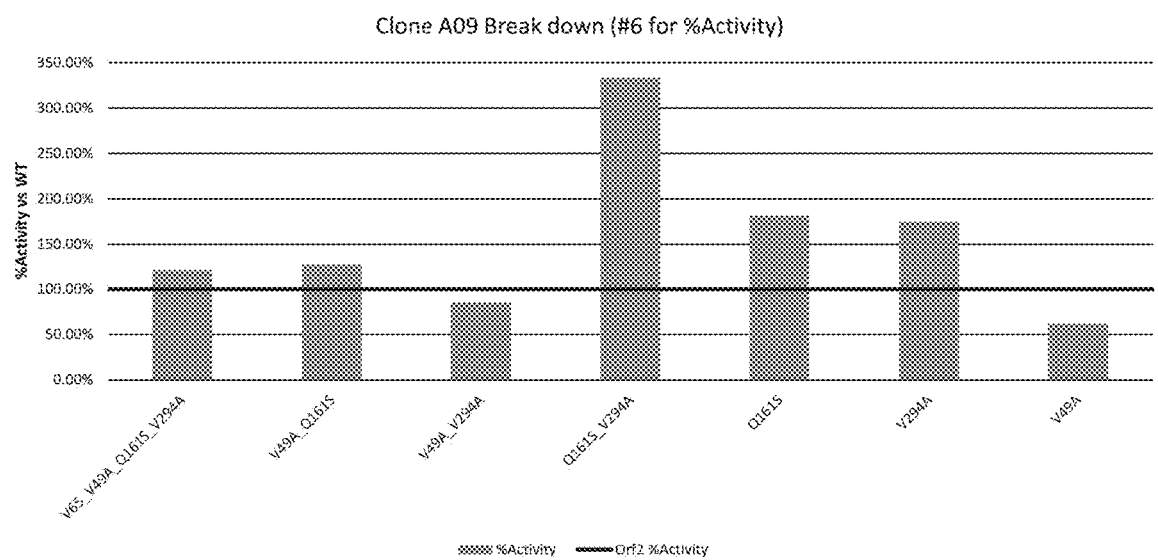
FIG. 79 shows % activity (using O as substrate and GPP as donor) of ORF2 mutants resulting from breakdown of tripe mutant clone A09.

Example 7: Generation of ORF2 Variants with Improved Enzymatic Function Using 0 as Substrate and GPP as Donor Six triple mutants (E09 carrying A53T_M106E_Q161S mutations; D12 carrying A53T_E112D_G205M; C06 carrying Q161A_M162F Q295A; C11 carrying E112D_L219F V294F; G12 carrying A17T_Q161W_A232S; and A09 carrying V49A_Q161S_V294A) had improved activity vs. the WT ORF2, based on FIG. 55. Out of these, A09 and E09 were targeted for "breakdown" analysis. For each parental clone targeted six unique mutants are generated (3 doubles and 3 singles). The % enzymatic activity when using O as substrate and GPP as donor was calculated for each of the single and double mutants derived from the breakdown analysis of E09 and A09. FIGS. 78 and 79 depict the % activity for the mutants derived from the breakdown of E09 (FIG. 78); and A09 (FIG. 79) triple mutant clones.

In a similar fashion, breakdown of the other triple mutants—D12, C06, C11 and G12—will be performed; and the % activity for the mutants derived from the breakdown of D12, C06, C11 and G12 will analyzed as described above.

Figure 80:
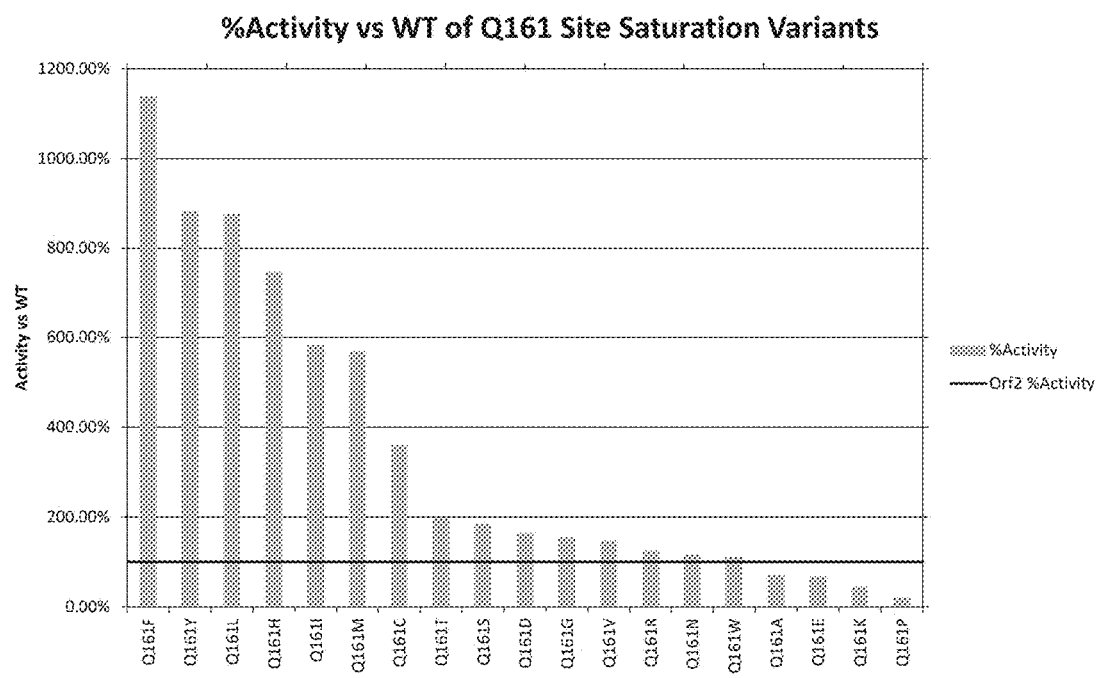
FIG. 80 shows % ORF2 activity (using O as substrate and GPP as donor) of Q161 site saturation ORF2 mutants.
Figure 81:
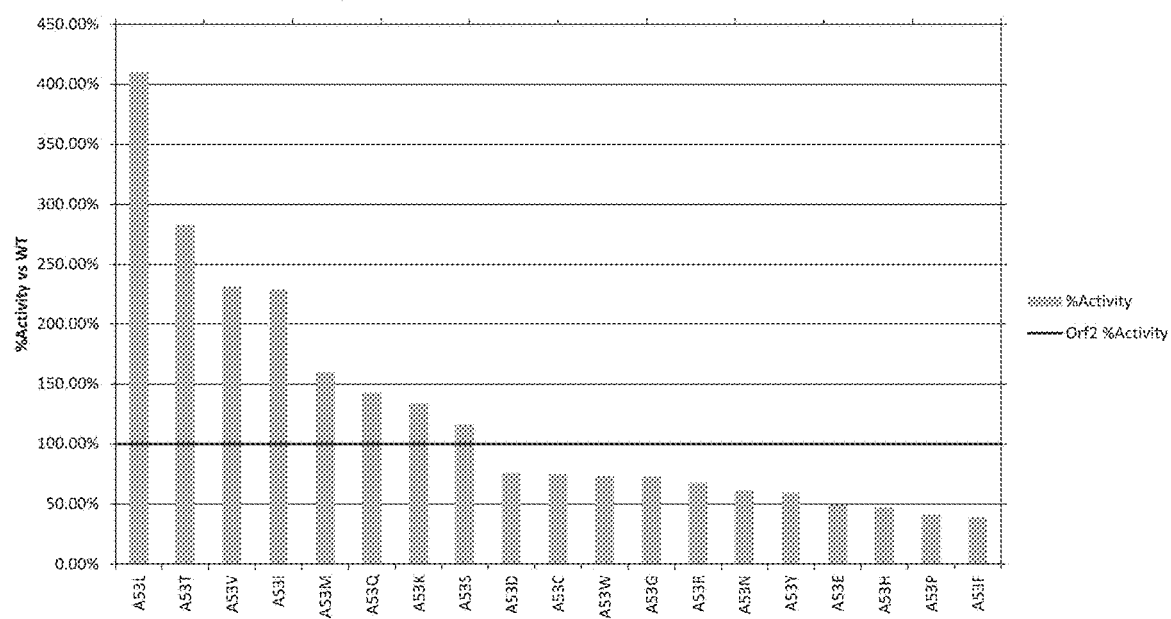
FIG. 81: % ORF2 activity (using O as substrate and GPP as donor) of A53 site saturation ORF2 mutants.
Figure 82:
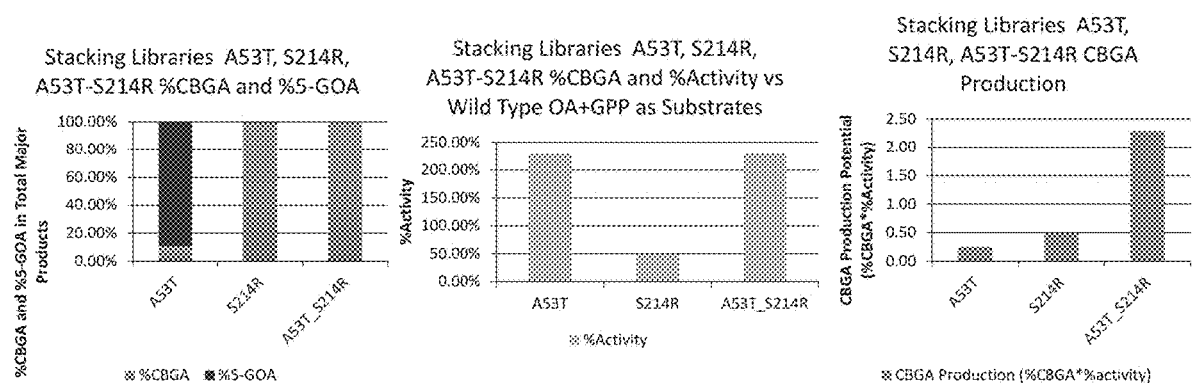
FIG. 82 shows ORF-2 activity (using OA as substrate and GPP as donor) of A53-S214R ORF2 double mutants.
Figure 83:
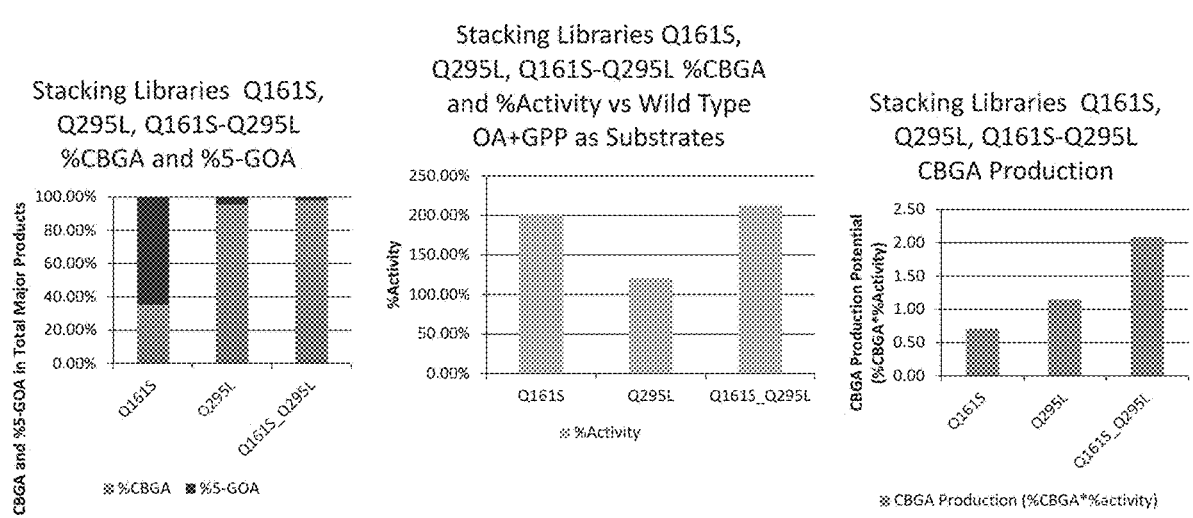
FIG. 83 shows ORF-2 activity (using OA as substrate and GPP as donor) of Q161S-Q295L ORF2 double mutants.
Figure 84:
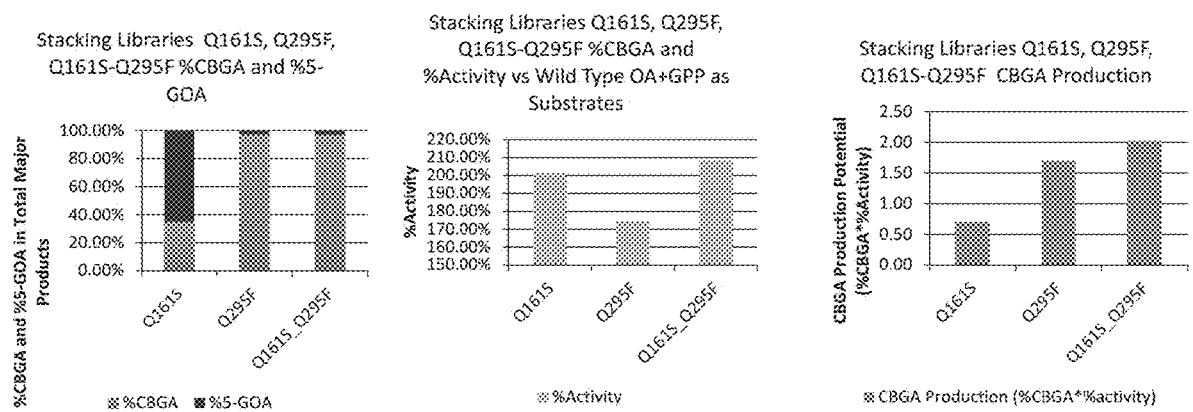
FIG. 84: ORF-2 activity (using OA as substrate and GPP as donor) of Q161S-Q295F ORF2 double mutants.
Figure 85:
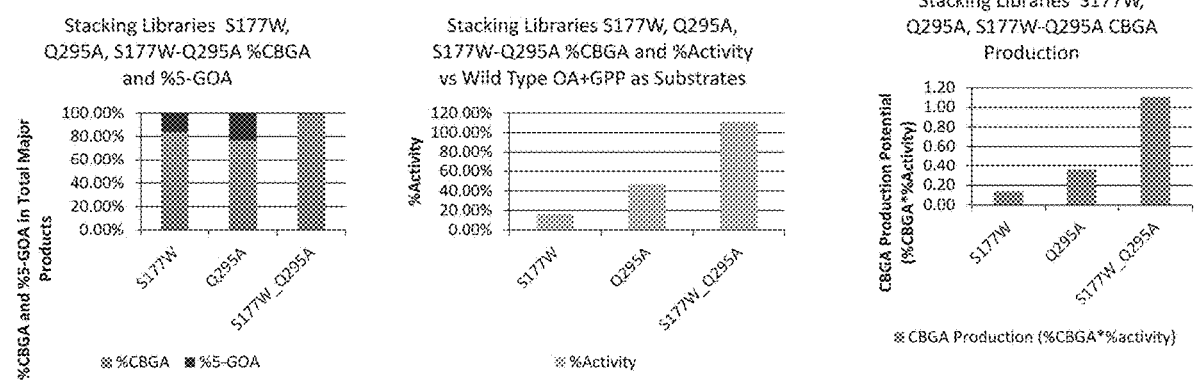
FIG. 85: ORF-2 activity (using OA as substrate and GPP as donor) of S177W-Q295A ORF2 double mutants.
Figure 86:
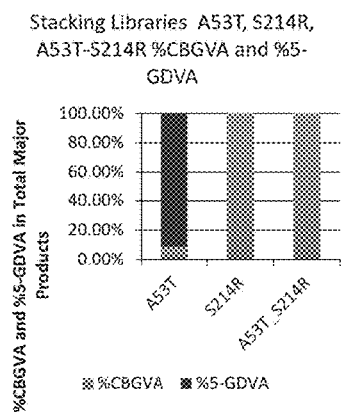
FIG. 86: ORF-2 activity (using DVA as substrate and GPP as donor) of A53-S214R ORF2 double mutants.
Figure 86:
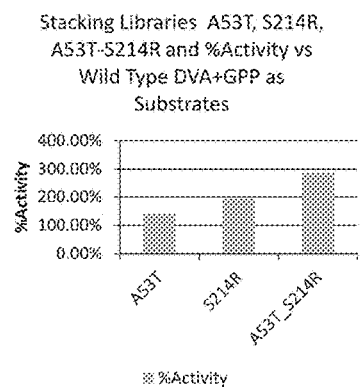
Figure 86:
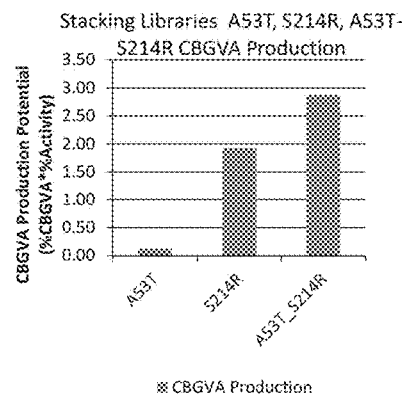
Figure 87:
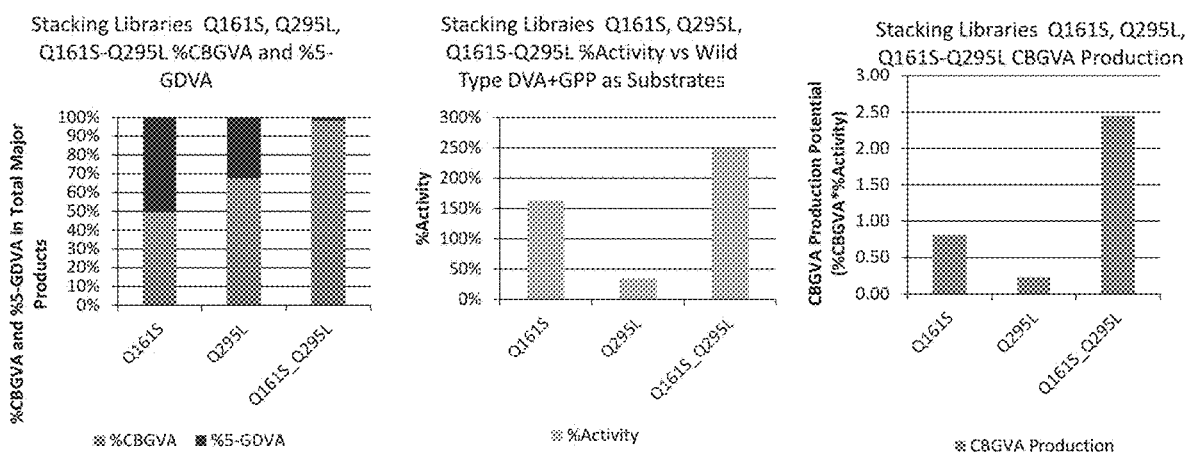
FIG. 87: ORF-2 activity (using DVA as substrate and GPP as donor) of Q161S-Q295L ORF2 double mutants.
Figure 88:
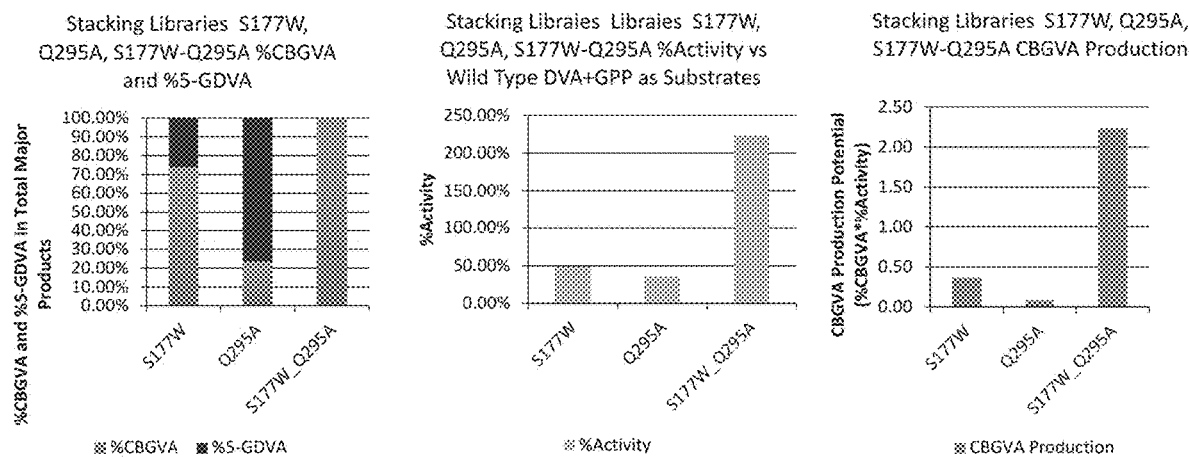
FIG. 88: ORF-2 activity (using DVA as substrate and GPP as donor) of S177W-Q295A ORF2 double mutants.
Figure 89:
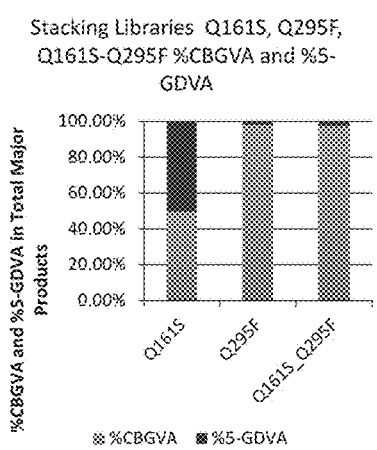
FIG. 89: ORF-2 activity (using DVA as substrate and GPP as donor) of Q161S-Q295F ORF2 double mutants.
Figure 89:
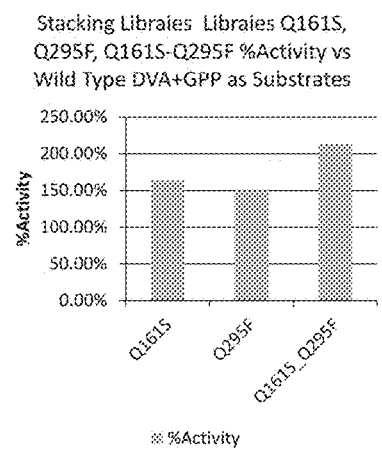
Figure 89:
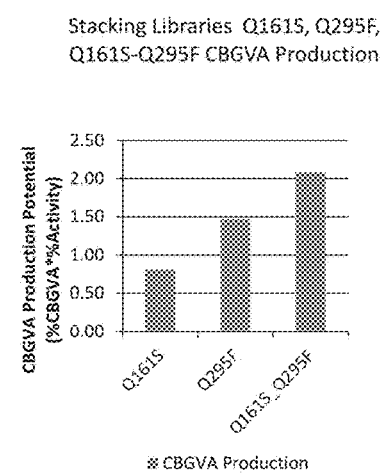
Figure 90:
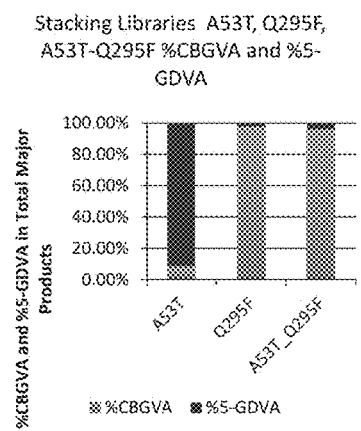
FIG. 90: ORF-2 activity (using DVA as substrate and GPP as donor) of A53T-Q295F ORF2 double mutants.
Figure 90:
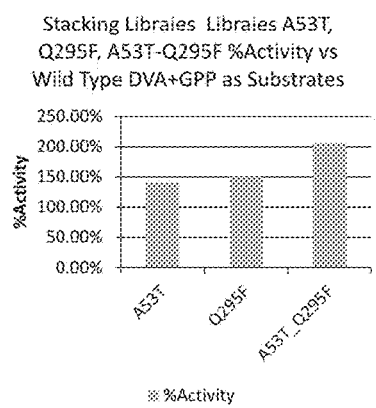
Figure 90:
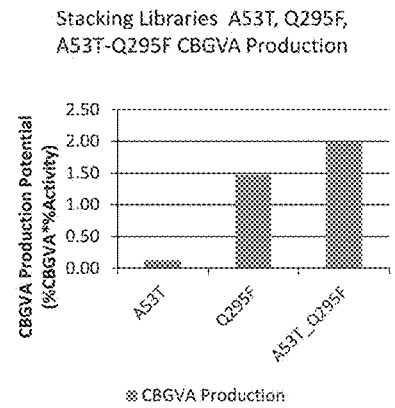
Figure 91:
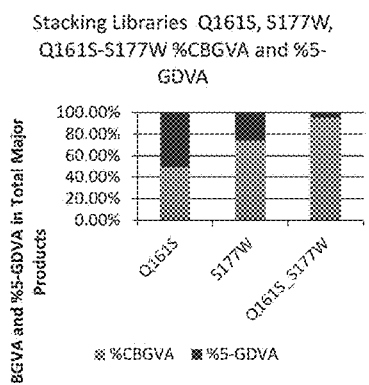
FIG. 91: ORF-2 activity (using DVA as substrate and GPP as donor) of Q161S-S177W ORF2 double mutants.
Figure 91:
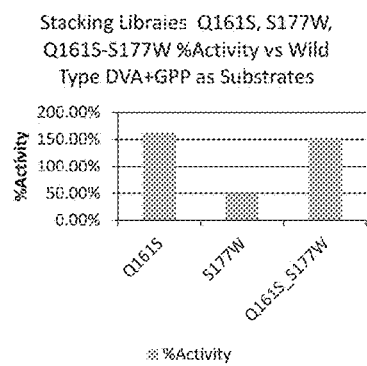
Figure 91:
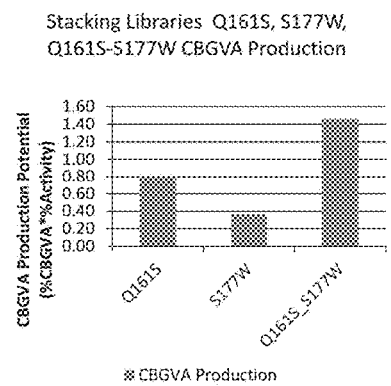
Figure 92:
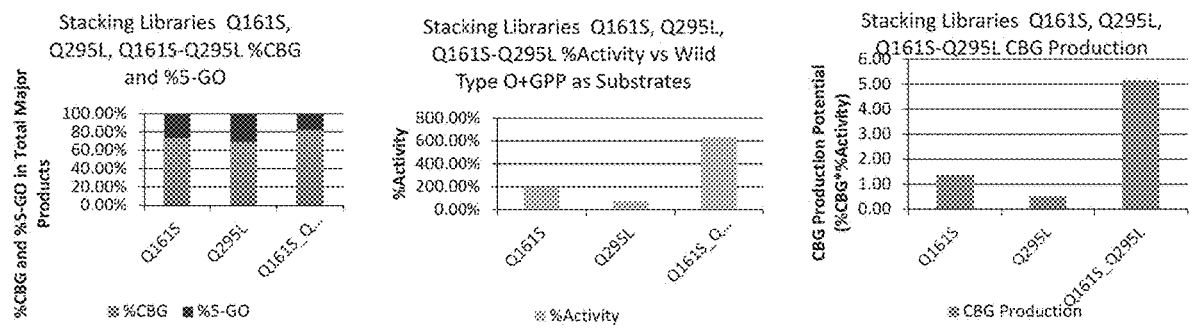
FIG. 92: ORF-2 activity (using O as substrate and GPP as donor) of Q161S-Q295L ORF2 double mutants.
Figure 93:
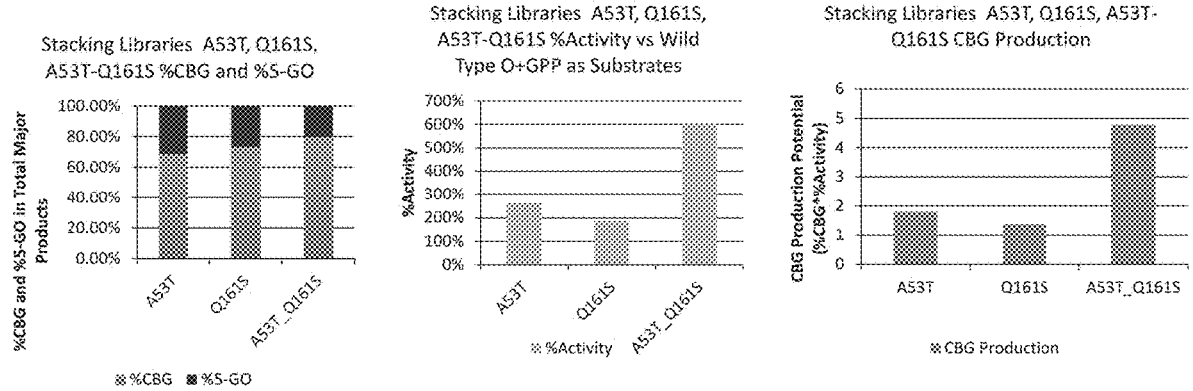
FIG. 93: ORF-2 activity (using O as substrate and GPP as donor) of A53T-Q161S ORF2 double mutants.
Figure 94:
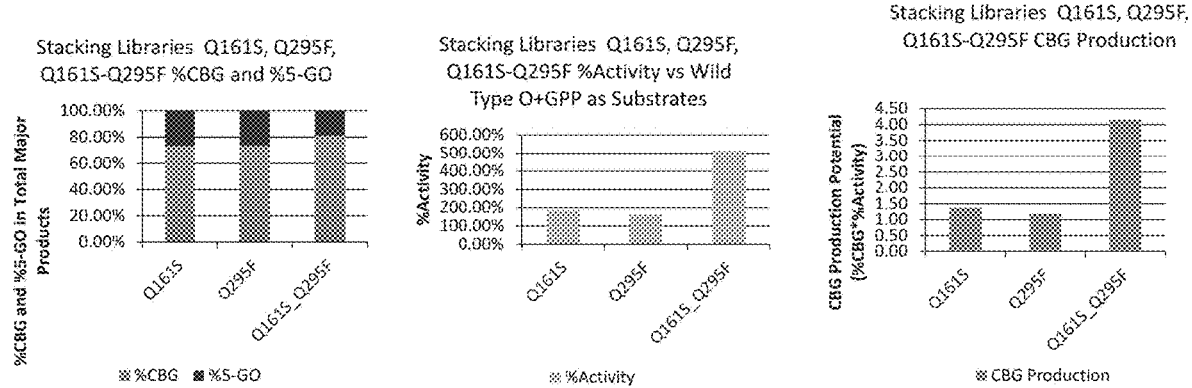
FIG. 94: ORF-2 activity (using O as substrate and GPP as donor) of Q161S-Q295F ORF2 double mutants.
Figure 95:
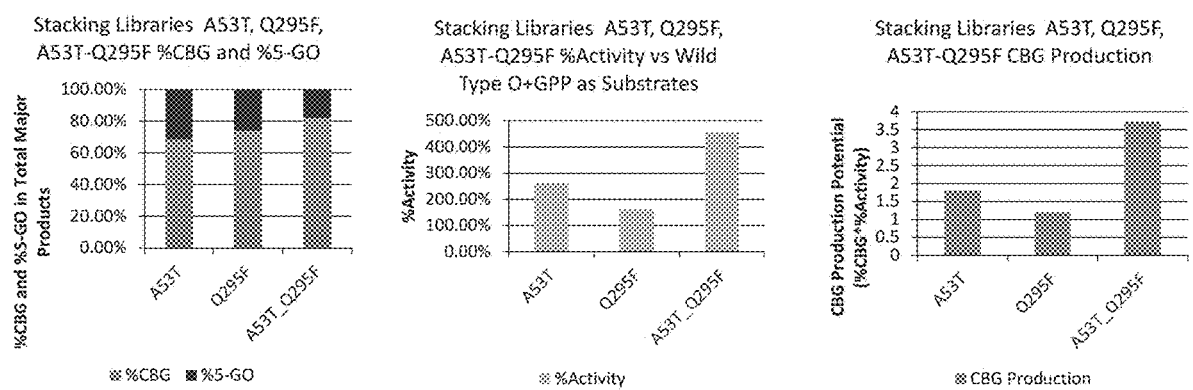
FIG. 95: ORF-2 activity (using O as substrate and GPP as donor) of A53T-Q295F ORF2 double mutants.
Figure 96:
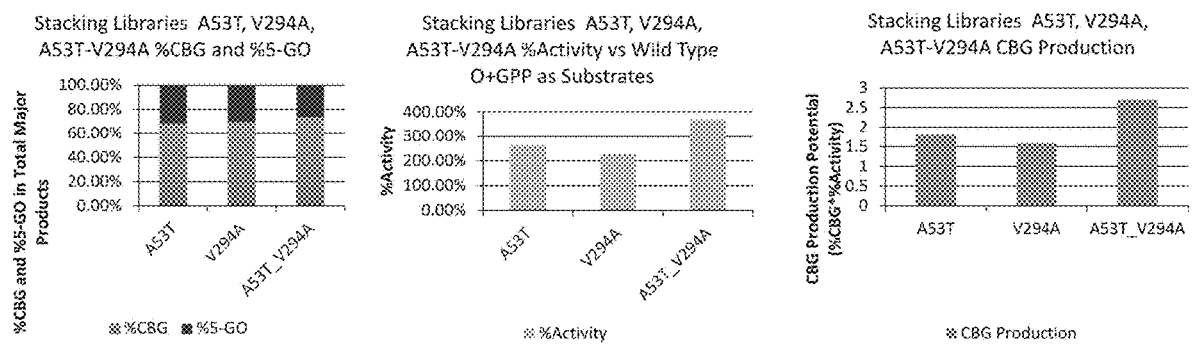
FIG. 96: ORF-2 activity (using O as substrate and GPP as donor) of A53T-V294A ORF2 double mutants.
Figure 97A:
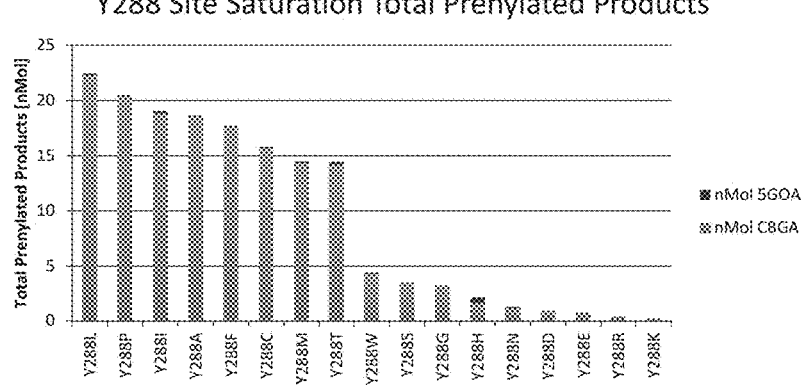
FIG. 97. Analysis of enzymatic activity of site-saturated ORF2 mutants of Y288 using OA as substrate and GPP as donor~including total prenylated products (FIG. 97A); CBGA production potential (FIG. 97B); and 5GOA production potential (FIG. 97C).
Figure 97B:
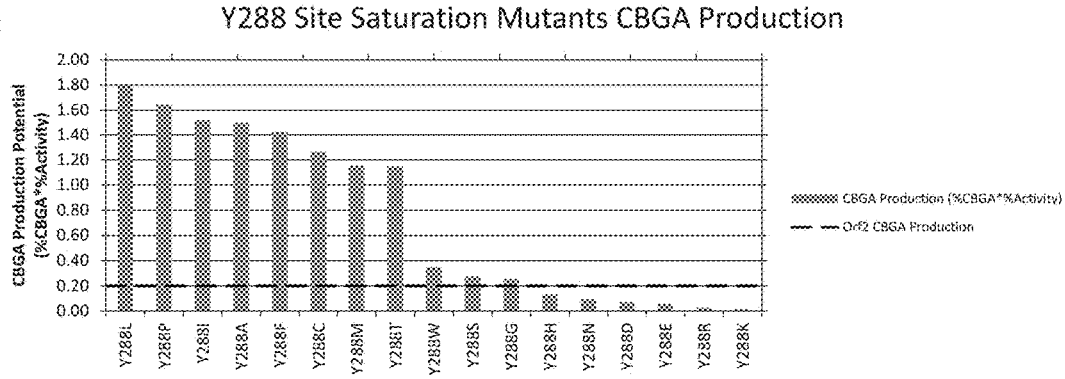
Figure 97C:
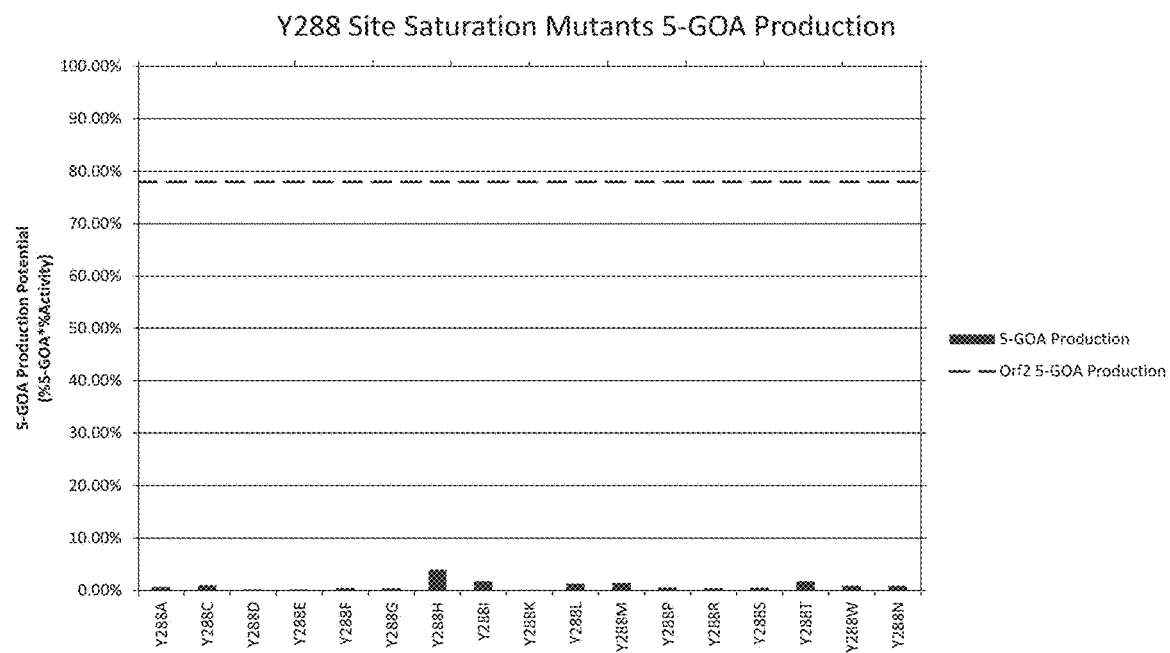

From the analysis of the breakdown mutants of E09 and A09, the following sites were identified as target residues for site saturation: V294, Q161, and A53. Site-saturated mutants of Q161, and A53 described in Examples 1 and 2 were analyzed to determine their % enzymatic activity as compared to WT ORF2 using O as substrate and GPP as donor. These results are depicted in FIG. 80 (Q161) and FIG. 81 (A53). From the results described above, multiple mutations of A53 and Q161 that have significantly higher % activity for producing CBG, as compared to WT ORF2, were identified. Thus, the ORF2 mutants disclosed herein have unexpectedly superior enzymatic functions, in a reaction using O as a substrate and GPP as donor, as compared to WT ORF2.

Site-saturated mutagenesis will be done in the same manner for V294; and % activity will be measured for each of these site saturated mutants.

Example 8: Analysis of ORF2 Mutant Function at pH 5.3

The library of tripleton mutants was screened for the ability to produce CBGA and 5-GOA using OA as substrate and Geranyl pyrophosphate (GPP) as donor at pH 5.3; and this enzymatic activity was compared to that of the WT ORF2. Table 30 provides the summary of the analysis performed on the enzymatic activity of the ORF2 triple mutants to produce CBG and 5-GO using O as substrate and Geranyl pyrophosphate (GPP) as donor.

TABLE 30

| CLONE ID | Mutations | CBGA | 5-GOA | nMol CBGA | nMol 5-GOA | Total Product | % CBGA | % Activity | CBGA Production | % 5-GOA | 5-GOA Production |
|---|---|---|---|---|---|---|---|---|---|---|---|
| F08 | A53T_N173D_S214R | 1.857 | 0.0154 | 0.489070319 | 0.010166359 | 0.499236677 | 98.0% | 70.98% | 0.70 | 2.04% | 0.01 |
| H02 | A53Q_S177W_L219F | 0.7295 | 0.1064 | 0.192125362 | 0.070240296 | 0.262365658 | 73.2% | 37.30% | 0.27 | 26.77% | 0.10 |
| E09 | A53T_M106E_Q161S | 0.7007 | 0.8385 | 0.184540427 | 0.553538421 | 0.738078848 | 25.0% | 104.94% | 0.26 | 75.00% | 0.79 |
| D12 | A53T_E112D_G205M | 0.6102 | 3.8502 | 0.16070582 | 2.541721679 | 2.7024275 | 5.9% | 384.22% | 0.23 | 94.05% | 3.61 |
| G12 | A17T_Q161W_A232S | 0.2702 | 0.0566 | 0.071161443 | 0.037364669 | 0.108526112 | 65.6% | 15.43% | 0.10 | 34.43% | 0.05 |
| C11 | E112D_L219F_V294F | 0.2299 | 1.1166 | 0.060547801 | 0.737127013 | 0.797674814 | 7.6% | 113.41% | 0.09 | 92.41% | 1.05 |
| D06 | A53E_Q161A_V294N | 0.1929 | 2.8479 | 0.050803266 | 1.880050172 | 1.930853437 | 2.6% | 274.52% | 0.07 | 97.37% | 2.67 |

TABLE 30-continued

| CLONE ID | Mutations | CBGA | 5-GOA | nMol CBGA | nMol 5-GOA | Total Product | % CBGA | % Activity | CBGA Production | % 5-GOA | 5-GOA Production |
|---|---|---|---|---|---|---|---|---|---|---|---|
| H10 | M162A_N173D_S214F | 0.1834 | 2.5826 | 0.04830129 | 1.704911539 | 1.75321283 | 2.8% | 249.26% | 0.07 | 97.24% | 2.42 |
| A09 | V49A_Q161S_V294A | 0.1672 | 0.1311 | 0.044034764 | 0.086546079 | 0.130580843 | 33.7% | 18.57% | 0.06 | 66.28% | 0.12 |
| D04 | A53T_D166E_Q295W | 0.1279 | 0.1365 | 0.033684488 | 0.090110906 | 0.123795393 | 27.2% | 17.60% | 0.05 | 72.79% | 0.13 |
| C06 | Q161A_M162F_Q295A | 0.0891 | 0.0334 | 0.023465894 | 0.022049115 | 0.04551501 | 51.6% | 6.47% | 0.03 | 48.44% | 0.03 |
| H11 | A108G_Q161S_G205M | 0.0876 | 0.12 | 0.023070845 | 0.079218379 | 0.102289224 | 22.6% | 14.54% | 0.03 | 77.45% | 0.11 |
| F09 | Q38G_D166E_Q295A | 0.0852 | 0.0626 | 0.022438767 | 0.041325588 | 0.063764355 | 35.2% | 9.07% | 0.03 | 64.81% | 0.06 |
| C12 | N173D_F213M_V294F | 0.0617 | 10.6898 | 0.016249671 | 7.056905202 | 7.073154873 | 0.2% | 1005.62% | 0.02 | 99.77% | 10.03 |
| A02 | Q38G_E112D_F123H | 0.0427 | 0.4286 | 0.01124572 | 0.282941642 | 0.294187363 | 3.8% | 41.83% | 0.02 | 96.18% | 0.40 |
| D11 | F123H_L174V_S177E | 0.0427 | 0.0282 | 0.01124572 | 0.018616319 | 0.029862039 | 37.7% | 4.25% | 0.02 | 62.34% | 0.03 |
| H05 | S177E_S214R_R228E | 0.0367 | 0.0116 | 0.009665525 | 0.007657777 | 0.017323302 | 55.8% | 2.46% | 0.01 | 44.21% | 0.01 |
| A10 | V49S_K118Q_S177E | 0.0302 | 0.0096 | 0.007953648 | 0.00633747 | 0.014291118 | 55.7% | 2.03% | 0.01 | 44.35% | 0.01 |
| H09 | E112G_G205M_L298W | 0.0255 | 0.22 | 0.006715828 | 0.145233694 | 0.151949523 | 4.4% | 21.60% | 0.01 | 95.58% | 0.21 |
| H03 | A17T_F213M_S214R | 0.0215 | 0.0107 | 0.005662365 | 0.007063639 | 0.012726004 | 44.5% | 1.81% | 0.01 | 55.51% | 0.01 |
| C03 | V49L_S214R_V271E | 0.0127 | 0.009 | 0.003344746 | 0.005941378 | 0.009286124 | 36.0% | 1.32% | 0.01 | 63.98% | 0.01 |
| G04 | D227E_R228E_L298Q | 0.011 | 0.0485 | 0.002897024 | 0.032017428 | 0.034914452 | 8.3% | 4.96% | 0.00 | 91.70% | 0.05 |
| H06 | V49L_E112D_G286E | 0.0109 | 0.0105 | 0.002870687 | 0.006931608 | 0.009802296 | 29.3% | 1.39% | 0.00 | 70.71% | 0.01 |
| H08 | M106E_M162A_Y216A | 0.0094 | 0.0425 | 0.002475639 | 0.028065509 | 0.030532148 | 8.1% | 4.34% | 0.00 | 91.89% | 0.04 |
| G02 | A53E_F213M_R228Q | 0.0092 | 0.2181 | 0.002422965 | 0.143979403 | 0.146402369 | 1.7% | 20.81% | 0.00 | 98.34% | 0.20 |
| B09 | C25V_F213M_Y216A | 0.0087 | 0.0575 | 0.002291283 | 0.037958806 | 0.040250089 | 5.7% | 5.72% | 0.00 | 94.31% | 0.05 |
| G05 | A53T_K118N_S214F | 0.0078 | 0.0297 | 0.002054253 | 0.019606549 | 0.021660802 | 9.5% | 3.08% | 0.00 | 90.52% | 0.03 |
| B08 | K118Q_L174V_R228Q | 0.0067 | 0.0208 | 0.001764551 | 0.013731186 | 0.015495737 | 11.4% | 2.20% | 0.00 | 88.61% | 0.02 |
| E10 | E112D_K119A_N173D | 0.0061 | 0.0176 | 0.001606531 | 0.011618696 | 0.013225227 | 12.1% | 1.88% | 0.00 | 87.85% | 0.02 |
| D08 | E112D_K119A_N173D | 0.0056 | 0.1394 | 0.001474849 | 0.09202535 | 0.093500198 | 1.6% | 13.29% | 0.00 | 98.42% | 0.13 |
| A08 | C25V_A232S_V271E | 0.0054 | 0.0077 | 0.001422175 | 0.005083179 | 0.006505355 | 21.9% | 0.92% | 0.00 | 78.14% | 0.01 |
| G03 | L219F_Y283L_L298W | 0.0053 | 0.0402 | 0.001395839 | 0.026538157 | 0.027933996 | 5.0% | 3.97% | 0.00 | 95.00% | 0.04 |
| G06 | K118Q_F123A_R228E | 0.0047 | 0.0306 | 0.001237819 | 0.020200687 | 0.021438506 | 5.8% | 3.05% | 0.00 | 94.23% | 0.03 |
| H01 | K119A_Q161A_R228Q | 0.0038 | 0.0277 | 0.00100079 | 0.018286242 | 0.019287033 | 5.2% | 2.74% | 0.00 | 94.81% | 0.03 |
| G08 | F123W_M162F_C209G | 0.0033 | 0.0004 | 0.000869107 | 0.000264061 | 0.001133168 | 76.7% | 0.16% | 0.00 | 23.30% | 0.00 |
| B04 | A53E_A108G_K118N | 0.0029 | 0.0075 | 0.000763761 | 0.004951491 | 0.00571491 | 13.4% | 0.81% | 0.00 | 86.64% | 0.01 |
| B10 | M106E_Y121W_D166E | 0.0028 | 0.0102 | 0.000737424 | 0.006733562 | 0.007470986 | 9.9% | 1.06% | 0.00 | 90.13% | 0.01 |
| B06 | D166E_S177Y_S214F | 0.0021 | 0.0146 | 0.000553068 | 0.009638236 | 0.010191304 | 5.4% | 1.45% | 0.00 | 94.57% | 0.01 |
| C02 | K118N_K119A_V271E | 0.0021 | 0.0038 | 0.000553068 | 0.002508582 | 0.00306165 | 18.1% | 0.44% | 0.00 | 81.94% | 0.00 |
| G07 | V49S_Y216A_V294N | 0.0021 | 0.0031 | 0.000553068 | 0.002046475 | 0.002599543 | 21.3% | 0.37% | 0.00 | 78.72% | 0.00 |
| B05 | A53Q_Y121W_A232S | 0.0019 | 0.0081 | 0.000500395 | 0.005347241 | 0.005847636 | 8.6% | 0.83% | 0.00 | 91.44% | 0.01 |
| G10 | V49A_Y121W_C230S | 0.0017 | 0.004 | 0.000447722 | 0.002640613 | 0.003088335 | 14.5% | 0.44% | 0.00 | 85.50% | 0.00 |
| D09 | K118N_C209G_R228Q | 0.0012 | 0.0002 | 0.000316039 | 0.000132031 | 0.00044807 | 70.5% | 0.06% | 0.00 | 29.47% | 0.00 |
| B02 | V49A_S177Y_C209G | 0.0009 | 0.0102 | 0.000237029 | 0.006733562 | 0.006970591 | 3.4% | 0.99% | 0.00 | 96.60% | 0.01 |
| C09 | A108G_K119D_L298A | 0.0009 | 0.0002 | 0.000237029 | 0.000132031 | 0.00036906 | 64.2% | 0.05% | 0.00 | 35.77% | 0.00 |
| B12 | A17T_F123W_L298A | 0.0009 | 0 | 0.000237029 | 0 | 0.000237029 | 100.0% | 0.03% | 0.00 | 0.00% | 0.00 |
| D07 | K119A_S214G_L298A | 0.0008 | 0.4619 | 0.000210693 | 0.304924743 | 0.305135435 | 0.1% | 43.38% | 0.00 | 99.93% | 0.43 |
| G09 | M106E_G205L_C209G | 0.0006 | 0.0001 | 0.000158019 | 6.60153E-05 | 0.000224035 | 70.5% | 0.03% | 0.00 | 29.47% | 0.00 |
| D01 | K118Q_Q161W_S214F | 0.0006 | 0.1332 | 0.000158019 | 0.0879324 | 0.08809042 | 0.2% | 12.52% | 0.00 | 99.82% | 0.13 |
| E08 | F123H_L274V_L298A | 0.0003 | 0.0002 | 7.90097E-05 | 0.000132031 | 0.00021104 | 37.4% | 0.03% | 0.00 | 62.56% | 0.00 |

Figure 111:
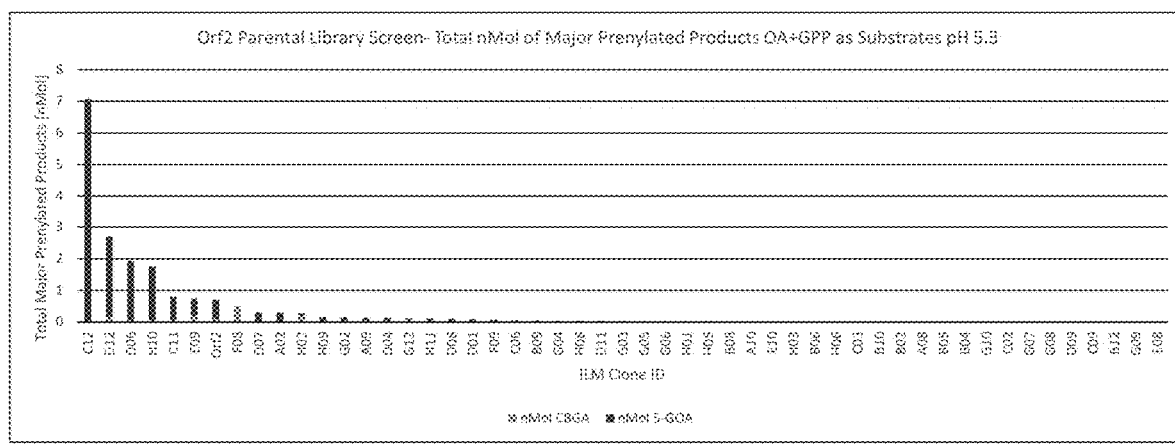
FIG. 111: Total nMol of prenylated products produced by ORF2 triple mutants using OA as substrate and GPP as donor at pH 5.3

The amount of CBGA and 5-GOA produced by each of the ORF2 triple mutants at pH 5.3 was measured using HPLC. FIG. 111 shows the total nMols of prenylated products generated using OA as substrate and GPP as donor by each of the ORF2 mutants, and the proportion of CBGA and 5-GOA within the total prenylated products. An exemplary wild type ORF2 replicate is included in the graph for comparison purposes. The results that show that in comparison with WT ORF2, which has low activity at this pH, some of the triple mutants have enhanced activity at this pH.

Figure 112:
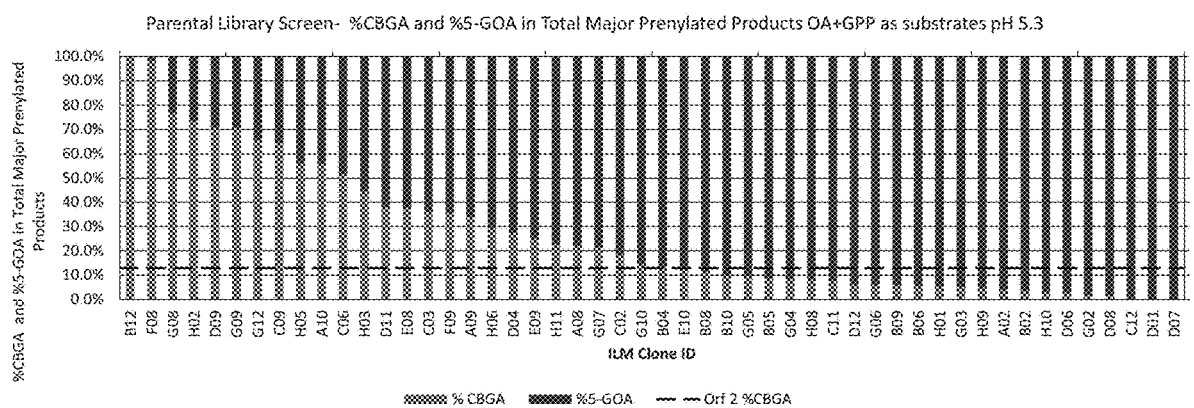
FIG. 112: % CBGA produced by ORF2 triple mutants using OA as substrate and GPP as donor pH 5.3

FIG. 112 shows the % CBGA and %5-GOA within the total prenylated products produced at pH 5.3 by each of the ORF2 triple mutant clones using OA as substrate and GPP as donor. In this graph, the mutant clones are ordered based on decreasing % CBGA (from left to right) they produce, with the % GO depicted in red. The black dashed line on the graph indicates the % CBGA that is produced by the wild type enzyme.

Figure 113:
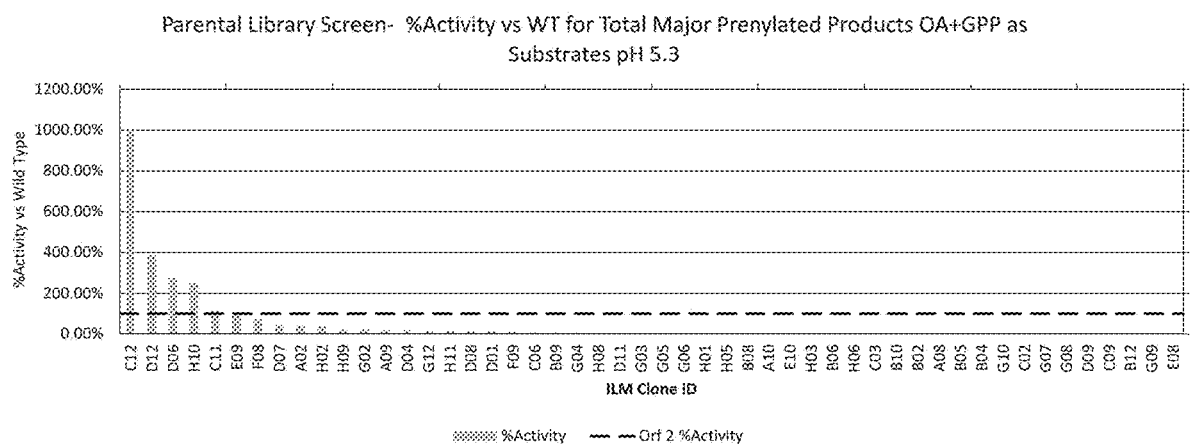
FIG. 113: % enzymatic activity of ORF2 triple mutants using OA as substrate and GPP as donor pH 5.3

FIG. 113 shows the ORF2 enzymatic activity (using OA as substrate and GPP as donor) of each of the triple mutant ORF2 clones relative to the wild type enzyme at pH 5.3. % activity was calculated by dividing the nMols of total prenylated products produced by a mutant by the nMols of total prenylated products produced by the wild type control, and expressed as a percentage. The black threshold line is the wild type ORF2% activity. The results show that at least 4 mutants have higher % activity at pH 5.3 compared to WT ORF2.

Figure 114:
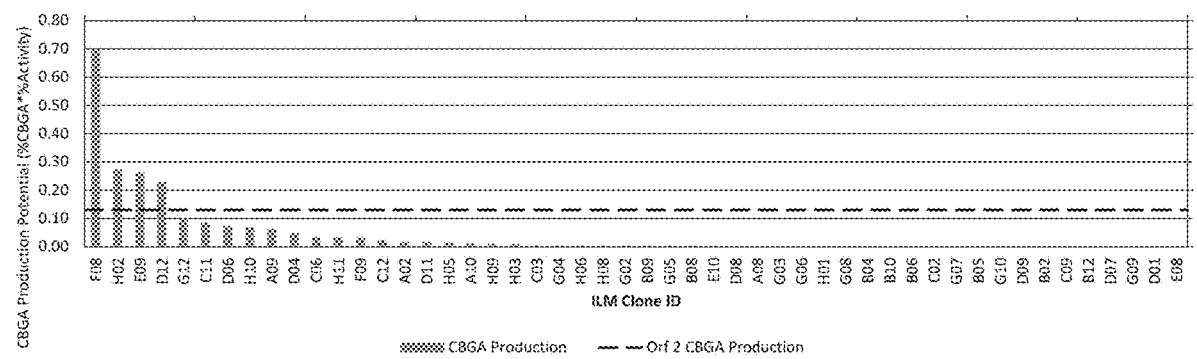
FIG. 114: CBGA production potential of ORF2 triple mutants using OA as substrate and GPP as donor pH 5.3

FIG. 114 shows the CBGA production potential of each of the ORF2 triple mutant clones when using OA as substrate and GPP as donor at pH 5.3. CBGA production potential (interchangeably referred to herein as CBGA production quotient) represents the improvement in CBG production vs. the wild type enzyme. CBGA production potential was calculated by multiplying the % CBGA of the Total Products by the % Activity of each mutant.

Figure 115:
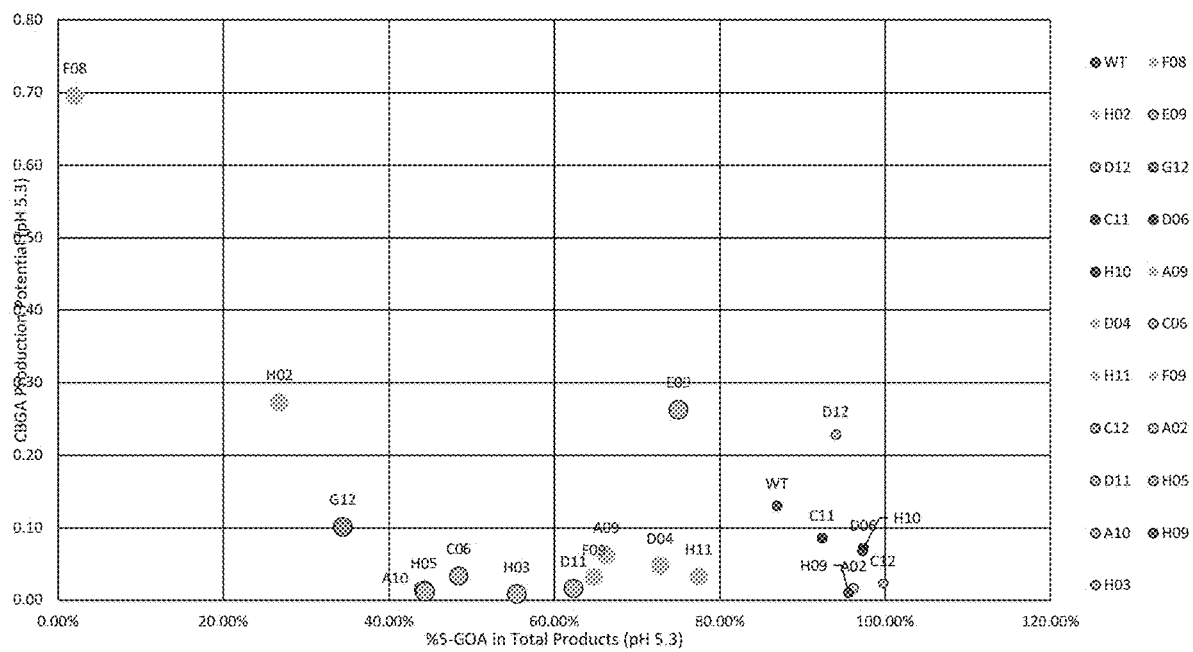
FIG. 115: Cluster map of ORF2 triple mutants clustered based on CBGA production potential and %5-GOA produced, using OA as substrate and GPP as donor pH 5.3
Figure 116:
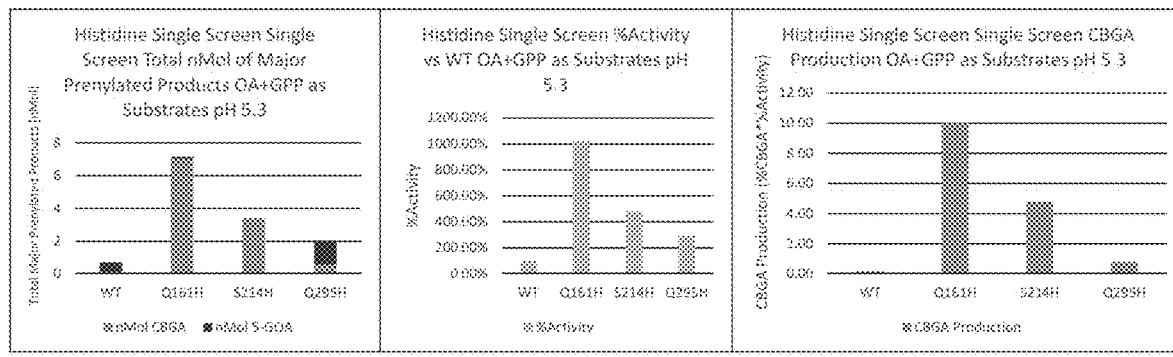
FIG. 116: Analysis of ORF2 enzymatic activity (using OA as substrate and GPP as donor) for ORF2 mutants having either Q161H, S214H, or Q295H mutation.

In the cluster analysis shown in FIG. 115, high 5-GOA producing mutants at pH 5.3 cluster together towards the right of the graph and high CBGA producing mutants at pH 5.3 cluster towards the left of the graph.

Based on the analysis performed in FIG. 115, the mutants which cluster to the left of the graph were selected for "breakdown" analysis based on the % CBGA produced (Table 31) and % activity (Table 32).

TABLE 31

| CBGA Production Rank (pH 5.3) | Clone ID | Mutations | Targeted for Breakdown |
|---|---|---|---|
| 1 | F08 | VA53T_N173D_S214R | YES |
| 2 | H02 | A53Q_S177W_L219F | YES |
| 3 | E09 | A53T_M106E_Q161S | YES |
| 5 | G12 | A17T_Q161W_A232S | YES |
| 9 | A09 | V49A_Q161S_V294A | YES |
| 10 | D04 | A53T_D166E_Q295W | YES |
| 11 | C06 | Q161A_M162F_Q295A | YES |
| 12 | H11 | A108G_Q161S_G205M | YES |
| 13 | F09 | Q38G_D166E_Q295A | YES |
| 16 | D11 | F123H_L174V_S177E | YES |
| 17 | H05 | S177E_S214R_R228E | YES |
| 18 | A10 | V49S_K118Q_S177E | YES |
| 20 | H03 | A17T_F213M_S214R | YES |

TABLE 32

| % Activity Rank (pH 5.3) | Clone ID | Mutations | Targeted for Breakdown |
|---|---|---|---|
| 1 | C12 | N173D_F213M_V294F | YES |
| 2 | D12 | A53T_E112D_G205M | YES |
| 3 | D06 | A53E_Q161A_V294N | YES |
| 4 | H10 | M162A_N173D_S214F | YES |
| 5 | C11 | E112D_L219F_V294F | YES |

Each of these triple mutants listed in Tables 31 and 32 will be broken down to their respective single mutants and double mutants; and all the ORF2 mutants thus generated will be analyzed for their activity at pH 5.3.

Finally, ORF2 mutants carrying point substitutions—Q161H, S214H, and Q295H mutations—were analyzed for their % activity and CBGA production potential at pH 5.3. The results surprisingly show that although WT ORF2 has little to no activity and little to no CBGA production potential at pH 5.3, Q161H and S214H have unexpectedly enhanced activity at this acidic pH. See FIG. 161 and Table 33.

TABLE 33

| Mutations | CBGA | 5-GOA | nMol CBGA | nMol 5-GOA | Total Product | % CBGA | % Activity | CBGA Production | % 5-GOA | 5-GOA Production |
|---|---|---|---|---|---|---|---|---|---|---|
| WT | 0.3478 | 0.9267 | 0.09159863 | 0.611763929 | 0.70336256 | 13.0% | 100.00% | 0.13 | 86.98% | 0.87 |
| Q161H | 26.7263 | 0.171 | 7.038793785 | 0.11288619 | 7.151679974 | 98.4% | 1016.78% | 10.01 | 1.58% | 0.16 |
| S214H | 12.8071 | 0.0115 | 3.372952331 | 0.007591761 | 3.380544092 | 99.8% | 480.63% | 4.80 | 0.22% | 0.01 |
| Q295H | 2.0712 | 2.266 | 0.545483276 | 1.49590705 | 2.041390327 | 26.7% | 290.23% | 0.78 | 73.28% | 2.13 |

Example 9: Amino Acid and Nucleic Acid Sequences

Table 34 lists all the amino acid sequences disclosed herein. Sequence information indicates the amino acid substitution of the sequence in comparison to the WT ORF2 (consensus ORF2).

TABLE 34

Amino acid sequences and their SEQ ID NO

| SEQ info | SEQ ID NO | Amino Acid Sequence |
|---|---|---|
| consensus Orf2 (NPhB) | 1 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| A108G_ Q295N_ L298Q | 2 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFGIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVNRGQLKAFDSLED** |
| K119A_ Q161S_ S177E | 3 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKATYAFFPTDNMPGVAELSAIPSMPPA VAENAELFARYGLDKVSMTSMDYKKRQVNLYFEELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49S_ M162A_ Y283L | 4 | MSEAADVERVYAAMEEAAGLLGVACARDKIYPLLSTFQDTLVEGGSVVSFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQATSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYLKLGAY YHITDVQRGLLKAFDSLED** |

TABLE 34-continued

Amino acid sequences and their SEQ ID NO

| SEQ info | SEQ ID NO | Amino Acid Sequence |
|---|---|---|
| K118Q_ Q161W_ S214F | 5 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFQKTYAFFPTDNMPGVAELSAIPSMPPA VAENAELFARYGLDKVWMTSMDYKKRQVNLYFSELSAQTLEAESVLALVRELGLHVPNELGLKFCKRSFFVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Q161A_ S214G_ V294F | 6 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVAMTSMDYKKRQVNLYFSELSAQTLEAESVLALVRELGLHVPNELGLKFCKRSFGVY PTLNWETGKIDRLCFAVISNDPTLVPSSDEGDIEKFHNYATKAPYAYVGEKRTLVYGLTLSPKEEYYKLGAY YHITDFQRGLLKAFDSLED** |
| F123W_ S177W_ G286E | 7 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAWFPTDNMPGVAELSAIPSMPPA VAENAELFARYGLDKVQMTSMDYKKRQVNLYFWELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLEAY YHITDVQRGLLKAFDSLED** |
| K118N_ N173D_ Q295N | 8 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFNKTYAFFPTDNMPGVAELSAIPSMPPA VAENAELFARYGLDKVQMTSMDYKKRQVDLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVNRGLLKAFDSLED** |
| K119A_ Q161A_ R228Q | 9 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKATYAFFPTDNMPGVAELSAIPSMPPA VAENAELFARYGLDKVAMTSMDYKKRQVNLYFSELSAQTLEAESVLALVRELGLHVPNELGLKFCKRSFSVY PTLNWETGKIDQLCFAVISNDPTLVPSSDEGDIEKFHNYATKAPYAYVGEKRTLVYGLTLSPKEEYYKLGAY YHITDVQRGLLKAFDSLED** |
| Q38G_ E112D_ F123H | 10 | MSEAADVERVYAAMEEAAGLLGVACARDKIYPLLSTFGDTLVEGGSVVVFSMASGRHSTELDFSISVPTSHG DPYATVVEKGLFPATGHPVDDLLADTQKHLPVSMFAIDGDVTGGFKKTYAHFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49A_ S177Y_ C209G | 11 | MSEAADVERVYAAMEEAAGLLGVACARDKIYPLLSTFQDTLVEGGSVVVAFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFYELSAQTLEAESVLALVRELGLHVPNELGLKFGKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| K118N_ K119A_ V271E | 12 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFNATYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLEYGLTLSPKEEYYKLGAY YHITDVQRGLLKAFDSLED** |
| L174V_ C230N_ L298Q | 13 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNVYFSELSAQTLEAESVLALVRELGLHVPNELGLKFCKRSFSVY PTLNWETGKIDRLNFAVISNDPTLVPSSDEGDIEKFHNYATKAPYAYVGEKRTLVYGLTLSPKEEYYKLGAY YHITDVQRGQLKAFDSLED** |
| K119D_ S177E_ L219F | 14 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKDTYAFFPTDNMPGVAELSAIPSMPPA VAENAELFARYGLDKVQMTSMDYKKRQVNLYFEELSAQTLEAESVLALVRELGLHVPNELGLKFCKRSFSVY PTFNWETGKIDRLCFAVISNDPTLVPSSDEGDIEKFHNYATKAPYAYVGEKRTLVYGLTLSPKEEYYKLGAY YHITDVQRGLLKAFDSLED** |
| A53E_ E112G_ R228E | 15 | MSEAADVERVYAAMEEAAGLLGVACARDKIYPLLSTFQDTLVEGGSVVVFSMESGRHSTELDFSISVPTSHG DPYATVVEKGLFPATGHPVDDLLADTQKHLPVSMFAIDGGVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDELCFAVISNDPTLVPSSDEGDIEKFHNYATKAPYAYVGEKRTLVYGLTLSPKEEYYKLGAY YHITDVQRGLLKAFDSLED** |
| A53E_ F213M_ R228Q | 16 | MSEAADVERVYAAMEEAAGLLGVACARDKIYPLLSTFQDTLVEGGSVVVFSMESGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSMSVY PTLNWETGKIDQLCFAVISNDPTLVPSSDEGDIEKFHNYATKAPYAYVGEKRTLVYGLTLSPKEEYYKLGAY YHITDVQRGLLKAFDSLED** |

TABLE 34-continued

Amino acid sequences and their SEQ ID NO

| SEQ info | SEQ ID NO | Amino Acid Sequence |
|---|---|---|
| A53Q_ S177W_ L219F | 17 | MSEAADVERVYAAMEEAAGLLGVACARDKIYPLLSTFQDTLVEGGSVVVFSMQSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFWELSAQTLEAESVLALVRELGLHVPNELGLKFCKRSFSVY PTFNWETGKIDRLCFAVISNDPTLVPSSDEGDIEKFHNYATKAPYAYVGEKRTLVYGLTLSPKEEYYKLGAY YHITDVQRGLLKAFDSLED** |
| F123A_ Y283L | 18 | MSEAADVERVYAAMEEAAGLLGVACARDKIYPLLSTFQDTLVEGGSVVLFSMASGRHSTELDFSISVPTSHG DPYATVVEKGLFPATGHPVDDLLADTQKHLPVSMFAIDGEVTGGFKKTYAAFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYLKLGAY YHITDVQRGLLKAFDSLED** |
| C25V_ Y121W_ M162F | 19 | MSEAADVERVYAAMEEAAGLLGVAVARDKIYPLLSTFQDTLVEGGSVVVFSMASGRHSTELDFSISVPTSHG DPYATVVEKGLFPATGHPVDDLLADTQKHLPVSMFAIDGEVTGGFKKTWAFFPTDNMPGVAELSAIPSMPPA VAENAELFARYGLDKVQFTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49L_ S214R_ V271E | 20 | MSEAADVERVYAAMEEAAGLLGVACARDKIYPLLSTFQDTLVEGGSVVLFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFRVY PTLNWETGKIDRLCFAVISNDPTLVPSSDEGDIEKFHNYATKAPYAYVGEKRTLEYGLTLSPKEEYYKLGAY YHITDVQRGLLKAFDSLED** |
| D227E_ C230N_ Q295W | 21 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIERLNFAVISNDPTLVPSSDEGDIEKFHNYATKAPYAYVGEKRTLVYGLTLSPKEEYYKLGAY YHITDVWRGLLKAFDSLED** |
| G205L_ Y216A_ C230S | 22 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELLLKFCKRSFSVA PTLNWETGKIDRLSFAVISNDPTLVPSSDEGDIEKFHNYATKAPYAYVGEKRTLVYGLTLSPKEEYYKLGAY YHITDVQRGLLKAFDSLED** |
| Q161S_ V294F_ L298W | 23 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDFQRGWLKAFDSLED** |
| L219F_ Y283L_ L298W | 24 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTFNWETGKIDRLCFAVISNDPTLVPSSDEGDIEKFHNYATKAPYAYVGEKRTLVYGLTLSPKEEYLKLGAY YHITDVQRGWLKAFDSLED** |
| A17T_ F213M_ S214R | 25 | MSEAADVERVYAAMEETAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSMRVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| L219F_ V294N_ Q295A | 26 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTFNWETGKIDRLCFAVISNDPTLVPSSDEGDIEKFHNYATKAPYAYVGEKRTLVYGLTLSPKEEYYKLGAY YHITDNARGLLKAFDSLED** |
| A53E_ A108G_ K118N | 27 | MSEAADVERVYAAMEEAAGLLGVACARDKIYPLLSTFQDTLVEGGSVVVFSMESGRHSTELDFSISVPTSHG DPYATVVEKGLFPATGHPVDDLLADTQKHLPVSMFGIDGEVTGGFNKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Q38G_ E112G_ M162F | 28 | MSEAADVERVYAAMEEAAGLLGVACARDKIYPLLSTFGDTLVEGGSVVVFSMASGRHSTELDFSISVPTSHG DPYATVVEKGLFPATGHPVDDLLADTQKHLPVSMFAIDGGVTGGFKKTYAFFPTDNMPGVAELSAIPSMPPA VAENAELFARYGLDKVQFTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |

TABLE 34-continued

Amino acid sequences and their SEQ ID NO

| SEQ info | SEQ ID NO | Amino Acid Sequence |
|---|---|---|
| A53T_<br>D166E_<br>Q295W | 29 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVWRGLLKAFDSLED** |
| L174V_<br>C230S_<br>V294A | 30 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNVYFSELSAQTLEAESVLALVRELGLHVPNELGLKFCKRSFSVY<br>PTLNWETGKIDRLSFAVISNDPTLVPSSDEGDIEKFHNYATKAPYAYVGEKRTLVYGLTLSPKEEYYKLGAY<br>YHITDAQRGLLKAFDSLED** |
| M106E_<br>G286E_<br>L298W | 31 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSEFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLEAY<br>YHITDVQRGWLKAFDSLED** |
| D227E_<br>R228E_<br>L298Q | 32 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIEELCFAVISNDPTLVPSSDEGDIEKFHNYATKAPYAYVGEKRTLVYGLTLSPKEEYYKLGAY<br>YHITDVQRGQLKAFDSLED** |
| M162A_<br>C209G_<br>Y288H | 33 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQATSMDYKKRQVNLYFSELSAQTLEAESVLALVRELGLHVPNELGLKFGKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| A17T_<br>C25V_<br>E112G | 34 | MSEAADVERVYAAMEETAGLLGVAVARDKIYPLLSTFQDTLVEGGSVVVFSMASGRHSTELDFSISVPTSHG<br>DPYATVVEKGLFPATGHPVDDLLADTQKHLPVSMFAIDGGVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53Q_<br>Y121W_<br>A232S | 35 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTWAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFSVISNDPTLVPSSDEGDIEKFHNYATKAPYAYVGEKRTLVYGLTLSPKEEYYKLGAY<br>YHITDVQRGLLKAFDSLED** |
| A53Q_<br>S177Y_<br>Y288H | 36 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| F123H_<br>L274V_<br>L298A | 37 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAHFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGVTLSPKEEYYKLGAY<br>YHITDVQRGALKAFDSLED** |
| S177W_<br>S214F_<br>Y283L | 38 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFWELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYLKLGAY<br>YHITDVQRGLLKAFDSLED** |
| A53E_<br>G205M_<br>L274V | 39 | MSEAADVERVYAAMEEAAGLLGVACARDKIYPLLSTFQDTLVEGGSVVVFSMESGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELMLKFCKRSFSVY<br>PTLNWETGKIDRLCFAVISNDPTLVPSSDEGDIEKFHNYATKAPYAYVGEKRTLVYGVTLSPKEEYYKLGAY<br>YHITDVQRGLLKAFDSLED** |
| A53T_<br>K118N_<br>S214F | 40 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFNKTYAFFPTDNMPGVAELSAIPSMPPA<br>VAENAELFARYGLDKVQMTSMDYKKRQVNLYFSELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| S177E_<br>S214R_<br>R228E | 41 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFEELSAQTLEAESVLALVRELGLHVPNELGLKFCKRSFRVY<br>PTLNWETGKIDELCFAVISNDPTLVPSSDEGDIEKFHNYATKAPYAYVGEKRTLVYGLTLSPKEEYYKLGAY<br>YHITDVQRGLLKAFDSLED** |
| K118Q_<br>S177Y_<br>D227E | 42 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFQKTYAFFPTDNMPGVAELSAIPSMPPA<br>VAENAELFARYGLDKVQMTSMDYKKRQVNLYFYELSAQTLEAESVLALVRELGLHVPNELGLKFCKRSFSVY<br>PTLNWETGKIERLCFAVISNDPTLVPSSDEGDIEKFHNYATKAPYAYVGEKRTLVYGLTLSPKEEYYKLGAY<br>YHITDVQRGLLKAFDSLED** |
| D166E_<br>S177Y_<br>S214F | 43 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFYELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161A_<br>M162F_<br>Q295A | 44 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVAFTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| A53E_<br>Q161A_<br>V294N | 45 | MSEAADVERVYAAMEEAAGLLGVACARDKIYPLLSTFQDTLVEGGSVVVFSMESGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVAMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDNQRGLLKAFDSLED** |
| A108G_<br>F123W_<br>V294A | 46 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFGIDGEVTGGFKKTYAWFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| A53Q_<br>G205L_<br>Q295N | 47 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELLLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVNRGLLKAFDSLED** |
| K118Q_<br>F123A_<br>R228E | 48 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFQKTYAAFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDELCFAVISNDPTLVPSSDEGDIEKFHNYATKAPYAYVGEKRTLVYGLTLSPKEEYYKLGAY<br>YHITDVQRGLLKAFDSLED** |
| V49L_<br>E112D_<br>G286E | 49 | MSEAADVERVYAAMEEAAGLLGVACARDKIYPLLSTFQDTLVEGGSVVLFSMASGRHSTELDFSISVPTSHG<br>DPYATVVEKGLFPATGHPVDDLLADTQKHLPVSMFAIDGDVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLEAY<br>YHITDVQRGLLKAFDSLED** |
| G205L_<br>R228E_<br>C230N | 50 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELLLKFCKRSFSVY<br>PTLNWETGKIDELNFAVISNDPTLVPSSDEGDIEKFHNYATKAPYAYVGEKRTLVYGLTLSPKEEYYKLGAY<br>YHITDVQRGLLKAFDSLED** |
| M162A_<br>D227E_<br>C230S | 51 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQATSMDYKKRQVNLYFSELSAQTLEAESVLALVRELGLHVPNELGLKFCKRSFSVY<br>PTLNWETGKIERLSFAVISNDPTLVPSSDEGDIEKFHNYATKAPYAYVGEKRTLVYGLTLSPKEEYYKLGAY<br>YHITDVQRGLLKAFDSLED** |
| V49L_<br>K119D_<br>G205M | 52 | MSEAADVERVYAAMEEAAGLLGVACARDKIYPLLSTFQDTLVEGGSVVLFSMASGRHSTELDFSISVPTSHG<br>DPYATVVEKGLFPATGHPVDDLLADTQKHLPVSMFAIDGEVTGGFKDTYAFFPTDNMPGVAELSAIPSMPPA<br>VAENAELFARYGLDKVQMTSMDYKKRQVNLYFSELSAQTLEAESVLALVRELGLHVPNELMLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| K119A_S214G_L298A | 53 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKATYAFFPTDNMPGVAELSAIPSMPPA<br>VAENAELFARYGLDKVQMTSMDYKKRQVNLYFSELSAQTLEAESVLALVRELGLHVPNELGLKFCKRSFGVY<br>PTLNWETGKIDRLCFAVISNDPTLVPSSDEGDIEKFHNYATKAPYAYVGEKRTLVYGLTLSPKEEYYKLGAY<br>YHITDVQRGALKAFDSLED** |
| Q38G_Y216A_A232S | 54 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVA<br>PTLNWETGKIDRLCFSVISNDPTLVPSSDEGDIEKFHNYATKAPYAYVGEKRTLVYGLTLSPKEEYYKLGAY<br>YHITDVQRGLLKAFDSLED** |
| Q161A_V271E_Q295W | 55 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVAMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLEYGLTLSPKEEYYKLGAY<br>YHITDVWRGLLKAFDSLED** |
| V49S_Y216A_V294N | 56 | MSEAADVERVYAAMEEAAGLLGVACARDKIYPLLSTFQDTLVEGGSVVSFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVA<br>PTLNWETGKIDRLCFAVISNDPTLVPSSDEGDIEKFHNYATKAPYAYVGEKRTLVYGLTLSPKEEYYKLGAY<br>YHITDNQRGLLKAFDSLED** |
| F123A_M162F_S214G | 57 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAAFPTDNMPGVAELSAIPSMPPA<br>VAENAELFARYGLDKVQFTSMDYKKRQVNLYFSELSAQTLEAESVLALVRELGLHVPNELGLKFCKRSFGVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| C25V_A232S_V271E | 58 | MSEAADVERVYAAMEEAAGLLGVAVARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFSVISNDPTLVPSSDEGDIEKFHNYATKAPYAYVGEKRTLEYGLTLSPKEEYYKLGAY<br>YHITDVQRGLLKAFDSLED** |
| K118Q_L174V_R228Q | 59 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFQKTYAFFPTDNMPGVAELSAIPSMPPA<br>VAENAELFARYGLDKVQMTSMDYKKRQVNVYFSELSAQTLEAESVLALVRELGLHVPNELGLKFCKRSFSVY<br>PTLNWETGKIDQLCFAVISNDPTLVPSSDEGDIEKFHNYATKAPYAYVGEKRTLVYGLTLSPKEEYYKLGAY<br>YHITDVQRGLLKAFDSLED** |
| V49S_S214G_V294A | 60 | MSEAADVERVYAAMEEAAGLLGVACARDKIYPLLSTFQDTLVEGGSVVSFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFGVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| E112D_K119A_N173D | 61 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGDVTGGFKATYAFFPTDNMPGVAELSAIPSMPPA<br>VAENAELFARYGLDKVQMTSMDYKKRQVDLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123W_Q161W_D227E | 62 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAWFPTDNMPGVAELSAIPSMPPA<br>VAENAELFARYGLDKVWMTSMDYKKRQVNLYFSELSAQTLEAESVLALVRELGLHVPNELGLKFCKRSFSVY<br>PTLNWETGKIERLCFAVISNDPTLVPSSDEGDIEKFHNYATKAPYAYVGEKRTLVYGLTLSPKEEYYKLGAY<br>YHITDVQRGLLKAFDSLED** |
| A53T_N173D_S214R | 63 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVDLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123W_M162F_C209G | 64 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAWFPTDNMPGVAELSAIPSMPPA<br>VAENAELFARYGLDKVQFTSMDYKKRQVNLYFSELSAQTLEAESVLALVRELGLHVPNELGLKFGKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| M106E_ M162A_ Y216A | 65 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSEFAIDGEVTGGFKKTYAFFPTDNMPGVAELSAIPSMPPA VAENAELFARYGLDKVQATSMDYKKRQVNLYFSELSAQTLEAESVLALVRELGLHVPNELGLKFCKRSFSVA PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49A_ Q161S_ V294A | 66 | MSEAADVERVYAAMEEAAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDAQRGLLKAFDSLED** |
| C25V_ F213M_ Y216A | 67 | MSEAADVERVYAAMEEAAGLLGVAVARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSMSVA PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| A108G_ K119D_ L298A | 68 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFGIDGEVTGGFKDTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGALKAFDSLED** |
| K118N_ C209G_ R228Q | 69 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFNKTYAFFPTDNMPGVAELSAIPSMPPA VAENAELFARYGLDKVQMTSMDYKKRQVNLYFSELSAQTLEAESVLALVRELGLHVPNELGLKFGKRSFSVY PTLNWETGKIDQLCFAVISNDPTLVPSSDEGDIEKFHNYATKAPYAYVGEKRTLVYGLTLSPKEEYYKLGAY YHITDVQRGLLKAFDSLED** |
| A53T_ M106E_ Q161S | 70 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSEFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Q38G_ D166E_ Q295A | 71 | MSEAADVERVYAAMEEAAGLLGVACARDKIYPLLSTFGDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMEYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVARGLLKAFDSLED** |
| M106E_ G205L_ C209G | 72 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSEFAIDGEVTGGFKKTYAFFPTDNMPGVAELSAIPSMPPA VAENAELFARYGLDKVQMTSMDYKKRQVNLYFSELSAQTLEAESVLALVRELGLHVPNELLLKFGKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| E112G_ G205M_ L298W | 73 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELMLKFCKRSFSVY PTLNWETGKIDRLCFAVISNDPTLVPSSDEGDIEKFHNYATKAPYAYVGEKRTLVYGLTLSPKEEYYKLGAY YHITDVQRGWLKAFDSLED** |
| V49S_ K118Q_ S177E | 74 | MSEAADVERVYAAMEEAAGLLGVACARDKIYPLLSTFQDTLVEGGSVVSFSMASGRHSTELDFSISVPTSHG DPYATVVEKGLFPATGHPVDDLLADTQKHLPVSMFAIDGEVTGGFQKTYAFFPTDNMPGVAELSAIPSMPPA VAENAELFARYGLDKVQMTSMDYKKRQVNLYFEELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| M106E_ Y121W_ D166E | 75 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSEFAIDGEVTGGFKKTWAFFPTDNMPGVAELSAIPSMPPA VAENAELFARYGLDKVQMTSMEYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| A53Q_ L274V_ Q295A | 76 | MSEAADVERVYAAMEEAAGLLGVACARDKIYPLLSTFQDTLVEGGSVVVFSMQSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGVTLSPKEEYYKLGAY YHITDVARGLLKAFDSLED** |

TABLE 34-continued

Amino acid sequences and their SEQ ID NO

| SEQ info | SEQ ID NO | Amino Acid Sequence |
|---|---|---|
| V49A_ F123A_ Y288H | 77 | MSEAADVERVYAAMEEAAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTYAAFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAH YHITDVQRGLLKAFDSLED** |
| C25V_ F123H_ Q295N | 78 | MSEAADVERVYAAMEEAAGLLGVAVARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAHFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVNRGLLKAFDSLED** |
| K119D_ Q161W_ L298Q | 79 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKDTYAFFPTDNMPGVAELSAIPSMPPA VAENAELFARYGLDKVWMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGQLKAFDSLED** |
| V49A_ Y121W_ C230S | 80 | MSEAADVERVYAAMEEAAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTWAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLSFAVISNDPTLVPSSDEGDIEKFHNYATKAPYAYVGEKRTLVYGLTLSPKEEYYKLGAY YHITDVQRGLLKAFDSLED** |
| M162A_ N173D_ S214F | 81 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQATSMDYKKRQVDLYFSELSAQTLEAESVLALVRELGLHVPNELGLKFCKRSFFVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49L_ D166E_ L274V | 82 | MSEAADVERVYAAMEEAAGLLGVACARDKIYPLLSTFQDTLVEGGSVVLFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMEYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGVTLSPKEEYYKLGAY YHITDVQRGLLKAFDSLED** |
| V49S_ K119D_ F213M | 83 | MSEAADVERVYAAMEEAAGLLGVACARDKIYPLLSTFQDTLVEGGSVVSFSMASGRHSTELDFSISVPTSHG DPYATVVEKGLFPATGHPVDDLLADTQKHLPVSMFAIDGEVTGGFKDTYAFFPTDNMPGVAELSAIPSMPPA VAENAELFARYGLDKVQMTSMDYKKRQVNLYFSELSAQTLEAESVLALVRELGLHVPNELGLKFCKRSMSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| E112D_ L219F_ V294F | 84 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGDVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTFNWETGKIDRLCFAVISNDPTLVPSSDEGDIEKFHNYATKAPYAYVGEKRTLVYGLTLSPKEEYYKLGAY YHITDFQRGLLKAFDSLED** |
| F123H_ L174V_ S177E | 85 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAHFPTDNMPGVAELSAIPSMPPA VAENAELFARYGLDKVQMTSMDYKKRQVNVYFEELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| E112G_ F123H_ S214G | 86 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGGVTGGFKKTYAHFPTDNMPGVAELSAIPSMPPA VAENAELFARYGLDKVQMTSMDYKKRQVNLYFSELSAQTLEAESVLALVRELGLHVPNELGLKFCKRSFGVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| F123A_ S177W_ G205L | 87 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAAFPTDNMPGVAELSAIPSMPPA VAENAELFARYGLDKVQMTSMDYKKRQVNLYFWELSAQTLEAESVLALVRELGLHVPNELLLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| S177W_ Y288H_ V294N | 88 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFWELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAH YHITDNQRGLLKAFDSLED** |

TABLE 34-continued

Amino acid sequences and their SEQ ID NO

| SEQ info | SEQ ID NO | Amino Acid Sequence |
|---|---|---|
| A108G_ Q161S_ G205M | 89 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFGIDGEVTGGFKKTYAFFPTDNMPGVAELSAIPSMPPA VAENAELFARYGLDKVSMTSMDYKKRQVNLYFSELSAQTLEAESVLALVRELGLHVPNELMLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Y121W_ S177Y_ G286E | 90 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTWAFFPTDNMPGVAELSAIPSMPPA VAENAELFARYGLDKVQMTSMDYKKRQVNLYFYELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLEAY YHITDVQRGLLKAFDSLED** |
| A17T_ F123W_ L298A | 91 | MSEAADVERVYAAMEETAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAWFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGALKAFDSLED** |
| N173D_ F213M_ V294F | 92 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVDLYFSELSAQTLEAESVLALVRELGLHVPNELGLKFCKRSMSVY PTLNWETGKIDRLCFAVISNDPTLVPSSDEGDIEKFHNYATKAPYAYVGEKRTLVYGLTLSPKEEYYKLGAY YHITDFQRGLLKAFDSLED** |
| A53T_ E112D_ G205M | 93 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGDVTGGFKKTYAFFPTDNMPGVAELSAIPSMPPA VAENAELFARYGLDKVQMTSMDYKKRQVNLYFSELSAQTLEAESVLALVRELGLHVPNELMLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Q38G_ L174V_ S214R | 94 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNVYFSELSAQTLEAESVLALVRELGLHVPNELGLKFCKRSFRVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| A17T_ V49A_ C230N | 95 | MSEAADVERVYAAMEETAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLNFAVISNDPTLVPSSDEGDIEKFHNYATKAPYAYVGEKRTLVYGLTLSPKEEYYKLGAY YHITDVQRGLLKAFDSLED** |
| A17T_ Q161W_ A232S | 96 | MSEAADVERVYAAMEETAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVWMTSMDYKKRQVNLYFSELSAQTLEAESVLALVRELGLHVPNELGLKFCKRSFSVY PTLNWETGKIDRLCFSVISNDPTLVPSSDEGDIEKFHNYATKAPYAYVGEKRTLVYGLTLSPKEEYYKLGAY YHITDVQRGLLKAFDSLED** |
| Q161W_ R228Q_ Q295W | 97 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVWMTSMDYKKRQVNLYFSELSAQTLEAESVLALVRELGLHVPNELGLKFCKRSFSVY PTLNWETGKIDQLCFAVISNDPTLVPSSDEGDIEKFHNYATKAPYAYVGEKRTLVYGLTLSPKEEYYKLGAY YHITDVWRGLLKAFDSLED** |
| Y288A | 98 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAA YHITDVQRGLLKAFDSLED** |
| Y288C | 99 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAC YHITDVQRGLLKAFDSLED** |
| Y288D | 100 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAD YHITDVQRGLLKAFDSLED** |

TABLE 34-continued

Amino acid sequences and their SEQ ID NO

| SEQ info | SEQ ID NO | Amino Acid Sequence |
|---|---|---|
| Y288E | 101 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAE<br>YHITDVQRGLLKAFDSLED** |
| Y288F | 102 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAF<br>YHITDVQRGLLKAFDSLED** |
| Y288G | 103 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAG<br>YHITDVQRGLLKAFDSLED** |
| Y288H | 104 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| Y288I | 105 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAI<br>YHITDVQRGLLKAFDSLED** |
| Y288K | 106 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAK<br>YHITDVQRGLLKAFDSLED** |
| Y288L | 107 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAL<br>YHITDVQRGLLKAFDSLED** |
| Y288M | 108 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAM<br>YHITDVQRGLLKAFDSLED** |
| Y288N | 109 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAN<br>YHITDVQRGLLKAFDSLED** |
| Y288P | 110 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAP<br>YHITDVQRGLLKAFDSLED** |
| Y288Q | 111 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAQ<br>YHITDVQRGLLKAFDSLED** |
| Y288R | 112 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAR<br>YHITDVQRGLLKAFDSLED** |

TABLE 34-continued

Amino acid sequences and their SEQ ID NO

| SEQ info | SEQ ID NO | Amino Acid Sequence |
|---|---|---|
| Y288S | 113 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAS<br>YHITDVQRGLLKAFDSLED** |
| Y288T | 114 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAT<br>YHITDVQRGLLKAFDSLED** |
| Y288V | 115 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAV<br>YHITDVQRGLLKAFDSLED** |
| Y288W | 116 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAW<br>YHITDVQRGLLKAFDSLED** |
| Y288Y | 117 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161A | 118 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVAMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161C | 119 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVCMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161D | 120 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVDMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161E | 121 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVEMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161F | 122 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVFMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161G | 123 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVGMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161H | 124 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVHMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| Q161I | 125 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVIMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161K | 126 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVKMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161L | 127 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVLMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161M | 128 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVMMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161N | 129 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVNMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161P | 130 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVPMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161Q | 131 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161R | 132 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVRMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161S | 133 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161T | 134 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVTMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161V | 135 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVVMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161W | 136 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVWMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| Q161Y | 137 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVYMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q295A | 138 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| Q295C | 139 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVCRGLLKAFDSLED** |
| Q295D | 140 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVDRGLLKAFDSLED** |
| Q295E | 141 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVERGLLKAFDSLED** |
| Q295F | 142 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVFRGLLKAFDSLED** |
| Q295G | 143 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVGRGLLKAFDSLED** |
| Q295H | 144 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVHRGLLKAFDSLED** |
| Q295I | 145 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVIRGLLKAFDSLED** |
| Q295K | 146 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVKRGLLKAFDSLED** |
| Q295L | 147 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVLRGLLKAFDSLED** |
| Q295M | 148 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVMRGLLKAFDSLED** |

TABLE 34-continued

Amino acid sequences and their SEQ ID NO

| SEQ info | SEQ ID NO | Amino Acid Sequence |
|---|---|---|
| Q295N | 149 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVNRGLLKAFDSLED** |
| Q295P | 150 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVPRGLLKAFDSLED** |
| Q295Q | 151 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q295R | 152 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVRRGLLKAFDSLED** |
| Q295S | 153 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVSRGLLKAFDSLED** |
| Q295T | 154 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVTRGLLKAFDSLED** |
| Q295V | 155 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVVRGLLKAFDSLED** |
| Q295W | 156 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVWRGLLKAFDSLED** |
| Q295Y | 157 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVYRGLLKAFDSLED** |
| S214A | 158 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFAVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214C | 159 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFCVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214D | 160 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFDVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| S214E | 161 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFEVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214F | 162 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214G | 163 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFGVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214H | 164 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFHVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214I | 165 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFIVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214K | 166 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFKVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214L | 167 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFLVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214M | 168 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFMVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214N | 169 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFNVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214P | 170 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFPVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214Q | 171 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFQVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214R | 172 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| S214S | 173 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214T | 174 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFTVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214V | 175 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFVVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214W | 176 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFWVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214Y | 177 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFYVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53A | 178 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53C | 179 | MSEAADVERVYAAMEEAAGLLGVACARDKIYPLLSTFQDTLVEGGSVVVFSMCSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53D | 180 | MSEAADVERVYAAMEEAAGLLGVACARDKIYPLLSTFQDTLVEGGSVVVFSMDSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53E | 181 | MSEAADVERVYAAMEEAAGLLGVACARDKIYPLLSTFQDTLVEGGSVVVFSMESGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53F | 182 | MSEAADVERVYAAMEEAAGLLGVACARDKIYPLLSTFQDTLVEGGSVVVFSMFSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53G | 183 | MSEAADVERVYAAMEEAAGLLGVACARDKIYPLLSTFQDTLVEGGSVVVFSMGSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53H | 184 | MSEAADVERVYAAMEEAAGLLGVACARDKIYPLLSTFQDTLVEGGSVVVFSMHSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| A53I | 185 | MSEAADVERVYAAMEEAAGLLGVACARDKIYPLLSTFQDTLVEGGSVVVFSMISGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53K | 186 | MSEAADVERVYAAMEEAAGLLGVACARDKIYPLLSTFQDTLVEGGSVVVFSMKSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53L | 187 | MSEAADVERVYAAMEEAAGLLGVACARDKIYPLLSTFQDTLVEGGSVVVFSMLSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53M | 188 | MSEAADVERVYAAMEEAAGLLGVACARDKIYPLLSTFQDTLVEGGSVVVFSMMSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53N | 189 | MSEAADVERVYAAMEEAAGLLGVACARDKIYPLLSTFQDTLVEGGSVVVFSMNSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53P | 190 | MSEAADVERVYAAMEEAAGLLGVACARDKIYPLLSTFQDTLVEGGSVVVFSMPSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53Q | 191 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53R | 192 | MSEAADVERVYAAMEEAAGLLGVACARDKIYPLLSTFQDTLVEGGSVVVFSMRSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53S | 193 | MSEAADVERVYAAMEEAAGLLGVACARDKIYPLLSTFQDTLVEGGSVVVFSMSSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T | 194 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53V | 195 | MSEAADVERVYAAMEEAAGLLGVACARDKIYPLLSTFQDTLVEGGSVVVFSMVSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53W | 196 | MSEAADVERVYAAMEEAAGLLGVACARDKIYPLLSTFQDTLVEGGSVVVFSMWSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| A53Y | 197 | MSEAADVERVYAAMEEAAGLLGVACARDKIYPLLSTFQDTLVEGGSVVVFSMYSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| V294N | 198 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDNQRGLLKAFDSLED** |
| L219F_<br>V294N | 199 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDNQRGLLKAFDSLED** |
| L219F_<br>Q295A | 200 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDVARGLLKAFDSLED** |
| V294N_<br>Q295A | 201 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDNARGLLKAFDSLED** |
| L219F | 202 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| V49A | 203 | MSEAADVERVYAAMEEAAGLLGVACARDKIYPLLSTFQDTLVEGGSVVAFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| V294A | 204 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| V49A_<br>V294A | 205 | MSEAADVERVYAAMEEAAGLLGVACARDKIYPLLSTFQDTLVEGGSVVAFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| Q161S_<br>V294A | 206 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| V49A_<br>Q161S | 207 | MSEAADVERVYAAMEEAAGLLGVACARDKIYPLLSTFQDTLVEGGSVVAFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S177Y | 208 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFYELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| Y288H | 209 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| A53Q_<br>Y288H | 210 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| S177Y_<br>Y288H | 211 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFYELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAH<br>YHITDVQRGLLKAFDSLED** |
| A53Q_<br>S177Y | 212 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFYELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| D166E | 213 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_<br>Q295W | 214 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVWRGLLKAFDSLED** |
| D166E_<br>Q295W | 215 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVWRGLLKAFDSLED** |
| A53T_<br>D166E | 216 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123H | 217 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAHFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| L174V | 218 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNVYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S177E | 219 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFEELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123H_<br>S177E | 220 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAHFPTDNMPGVAELSAIPSMPPA<br>VAENAELFARYGLDKVQMTSMDYKKRQVNLYFEELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| L174V_S177E | 221 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNVYFEELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123H_L174V | 222 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAHFPTDNMPGVAELSAIPSMPPA<br>VAENAELFARYGLDKVQMTSMDYKKRQVNVYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| M106E | 223 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSEFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_Q161S | 224 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| M106E_Q161S | 225 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSEFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_M106E | 226 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSEFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q38G | 227 | MSEAADVERVYAAMEEAAGLLGVACARDKIYPLLSTFGDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| D166E | 228 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q295A | 229 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| Q38G_Q295A | 230 | MSEAADVERVYAAMEEAAGLLGVACARDKIYPLLSTFGDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| D166E_Q295A | 231 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| Q38G_D166E | 232 | MSEAADVERVYAAMEEAAGLLGVACARDKIYPLLSTFGDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMEYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| K118N | 233 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFNKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214F | 234 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_<br>S214F | 235 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| K118N_<br>S214F | 236 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFNKTYAFFPTDNMPGVAELSAIPSMPPA<br>VAENAELFARYGLDKVQMTSMDYKKRQVNLYFSELSAQTLEAESVLALVRELGLHVPNELGLKFCKRSFFVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_<br>K118N | 237 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFNKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S177W | 238 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFWELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| L219F | 239 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S177W_<br>L219F | 240 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFWELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53Q_<br>S177W | 241 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFWELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53Q_<br>L219F | 242 | MSEAADVERVYAAMEEAAGLLGVACARDKIYPLLSTFQDTLVEGGSVVVFSMQSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTFNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A108G | 243 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFGIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| G205M | 244 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELMLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| A108G_G205M | 245 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFGIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELMLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161S_G205M | 246 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELMLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A108G_Q161S | 247 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFGIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| K118Q | 248 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFQKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| M162A | 249 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQATSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Y283L | 250 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYLKLGAY<br>YHITDVQRGLLKAFDSLED** |
| V271E | 251 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLEYGLTLSPKEEYYKLGAY<br>YHITDVQRGLLKAFDSLED** |
| K119D | 252 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKDTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| L274V | 253 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGVTLSPKEEYYKLGAY<br>YHITDVQRGLLKAFDSLED** |
| A232S | 254 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFSVISNDPTLVPSSDEGDIEKFHNYATKAPYAYVGEKRTLVYGLTLSPKEEYYKLGAY<br>YHITDVQRGLLKAFDSLED** |
| Q161A | 255 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVAMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| G205L | 256 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELLLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| S214G | 257 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFGVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Y216A | 258 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVA<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| N173D | 259 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVDLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123W | 260 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAWFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| K118N | 261 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFNKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| R228Q | 262 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDQLCFAVISNDPTLVPSSDEGDIEKFHNYATKAPYAYVGEKRTLVYGLTLSPKEEYYKLGAY<br>YHITDVQRGLLKAFDSLED** |
| Q161W | 263 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVWMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| V294F | 264 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDFQRGLLKAFDSLED** |
| S214R | 265 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| G286E | 266 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLEAY<br>YHITDVQRGLLKAFDSLED** |
| R228E | 267 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDELCFAVISNDPTLVPSSDEGDIEKFHNYATKAPYAYVGEKRTLVYGLTLSPKEEYYKLGAY<br>YHITDVQRGLLKAFDSLED** |
| C230S | 268 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLSFAVISNDPTLVPSSDEGDIEKFHNYATKAPYAYVGEKRTLVYGLTLSPKEEYYKLGAY<br>YHITDVQRGLLKAFDSLED** |

TABLE 34-continued

Amino acid sequences and their SEQ ID NO

| SEQ info | SEQ ID NO | Amino Acid Sequence |
|---|---|---|
| D227E | 269 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIERLCFAVISNDPTLVPSSDEGDIEKFHNYATKAPYAYVGEKRTLVYGLTLSPKEEYYKLGAY<br>YHITDVQRGLLKAFDSLED** |
| M162F | 270 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQFTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| F123A | 271 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAAFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_<br>V294A | 272 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| A53T_<br>Q161S_<br>V294A | 273 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAQRGLLKAFDSLED** |
| A53T_<br>Q161S_<br>V294N | 274 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDNQRGLLKAFDSLED** |
| A53T_<br>Q295A | 275 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| Q161S_<br>V294A_<br>Q295A | 276 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAARGLLKAFDSLED** |
| A53T_<br>Q161S_<br>Q295A | 277 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVARGLLKAFDSLED** |
| A53T_<br>V294A_<br>Q295A | 278 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAARGLLKAFDSLED** |
| A53T_<br>Q161S_<br>V294A_<br>Q295A | 279 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDAARGLLKAFDSLED** |
| A53T_<br>Q161S_<br>V294N_<br>Q295A | 280 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDNARGLLKAFDSLED** |

TABLE 34-continued

Amino acid sequences and their SEQ ID NO

| SEQ info | SEQ ID NO | Amino Acid Sequence |
|---|---|---|
| A53T Q295W | 281 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVWRGLLKAFDSLED** |
| Q161S_ V294A_ Q295W | 282 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDAWRGLLKAFDSLED** |
| A53T_ Q161S_ Q295W | 283 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVWRGLLKAFDSLED** |
| A53T_ V294A_ Q295W | 284 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDAWRGLLKAFDSLED** |
| A53T_ Q161S_ V294A_ Q295W | 285 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDAWRGLLKAFDSLED** |
| A53T_ Q161S_ V294N_ Q295W | 286 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDNWRGLLKAFDSLED** |
| S177W_ Q295A | 287 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFWELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVARGLLKAFDSLED** |
| S177W_ S214R | 288 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFWELSAQTLEAESVLALVRELGLHVPNELGLKFCKRSFRVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| Q161S_ S177W | 289 | MSEAADVERVYAAMEEAAGLLGVACARDKIYPLLSTFQDTLVEGGSVVVFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVSMTSMDYKKRQVNLYFWELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| A53T_ S177W | 290 | MSEAADVERVYAAMEEAAGLLGVACARDKIYPLLSTFQDTLVEGGSVVVFSMTSGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFWELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |
| V49A_ Q295L | 291 | MSEAADVERVYAAMEEAAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFSVY PTLNWETGKIDRLCFAVISNDPTLVPSSDEGDIEKFHNYATKAPYAYVGEKRTLVYGLTLSPKEEYYKLGAY YHITDVLRGLLKAFDSLED** |
| V49A_ S214R | 292 | MSEAADVERVYAAMEEAAGLLGVACARDKIYPLLSTFQDTLVEGGSVVAFSMASGRHSTELDFSISVPTSHG DPYATVVEKGLFPATGHPVDDLLADTQKHLPVSMFAIDGEVTGGFKKTYAFFPTDNMPGVAELSAIPSMPPA VAENAELFARYGLDKVQMTSMDYKKRQVNLYFSELSAQTLEAESVLALVRELGLHVPNELGLKFCKRSFRVY PTLNWETGKIDRLCFAVISNDPTLVPSSDEGDIEKFHNYATKAPYAYVGEKRTLVYGLTLSPKEEYYKLGAY YHITDVQRGLLKAFDSLED** |

TABLE 34-continued

Amino acid sequences and their SEQ ID NO

| SEQ info | SEQ ID NO | Amino Acid Sequence |
| --- | --- | --- |
| A53T_Q295F | 293 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVFRGLLKAFDSLED** |
| A53T_S214R | 294 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| A53T_Q161S | 295 | MSEAADVERVYAAMEEAAGLLGVACARDKIYPLLSTFQDTLVEGGSVVVFSMTSGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| Q161S_Q295F | 296 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVFRGLLKAFDSLED** |
| Q161S_Q295L | 297 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVLRGLLKAFDSLED** |
| Q161S_S214R | 298 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |
| S214R_Q295F | 299 | MSEAADVERVYAAMEEAAGLLGVACARDKIYPLLSTFQDTLVEGGSVVVFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVQMTSMDYKKRQVNLYFSELSAQTLEAESVLALVRELGLHVPNELGLKFCKRSFRVY<br>PTLNWETGKIDRLCFAVISNDPTLVPSSDEGDIEKFHNYATKAPYAYVGEKRTLVYGLTLSPKEEYYKLGAY<br>YHITDVFRGLLKAFDSLED** |
| V49A_Q161S | 300 | MSEAADVERVYAAMEEAAGLLGVACARDKIYPLLSTFQDTLVEGGSVVAFSMASGRHSTELDFSISVPTSHG<br>DPYATVVEKGLFPATGHPVDDLLADTQKHLPVSMFAIDGEVTGGFKKTYAFFPTDNMPGVAELSAIPSMPPA<br>VAENAELFARYGLDKVSMTSMDYKKRQVNLYFSELSAQTLEAESVLALVRELGLHVPNELGLKFCKRSFSVY<br>PTLNWETGKIDRLCFAVISNDPTLVPSSDEGDIEKFHNYATKAPYAYVGEKRTLVYGLTLSPKEEYYKLGAY<br>YHITDVQRGLLKAFDSLED** |

Table 35 lists all the nucleic acid sequences disclosed herein. The protein sequence (WT or mutant ORF2) encoded by the respective nucleic acid sequence is provided in Column 1 of Table 35.

TABLE 35

Nucleic acid sequences and their SEQ ID NO

| SEQ info | SEQ ID NO | DNA Sequence |
| --- | --- | --- |
| Consensus Orf2 (NphB) | 301 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA |

TABLE 35-continued

Nucleic acid sequences and their SEQ ID NO

| SEQ info | SEQ ID NO | DNA Sequence |
|---|---|---|
| | | GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGTGGGCGCGTACTACCACA<br>TTACCGACGTTCAACGTGGCCTGCTGAAAGCGTTTGACTCTTTGGAAGATTAATGA |
| A108G_<br>Q295N_<br>L298Q | 302 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAAAGGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGTGGGCGCGTACTACCACA<br>TTACCGACGTTAACCGTGGCCAGCTGAAAGCGTTTGACTCTTTGGAAGATTAATGA |
| K119A_<br>Q161S_<br>S177E | 303 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAGCGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGTGGGCGCGTACTACCACA<br>TTACCGACGTTCAACGTGGCCTGCTGAAAGCGTTTGACTCTTTGGAAGATTAATGA |
| V49S_<br>M162A_<br>Y283L | 304 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCA<br>GCTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACCTGAAGTGGGCGCGTACTACCACA<br>TTACCGACGTTCAACGTGGCCTGCTGAAAGCGTTTGACTCTTTGGAAGATTAATGA |
| K118Q_<br>Q161W_<br>S214F | 305 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCCAGAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGTGGGCGCGTACTACCACA<br>TTACCGACGTTCAACGTGGCCTGCTGAAAGCGTTTGACTCTTTGGAAGATTAATGA |
| Q161A_<br>S214G_<br>V294F | 306 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTGGTGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGTGGGCGCGTACTACCACA<br>TTACCGACTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| F123W_ S177W_ G286E | 307 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTGGTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCTGGGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGAGGCGTACTACCACA TTACCGACGTTCAACGTGGCCTGCTGAAAGCGTTTGACTCTTTGGAAGATTAATGA |
| K118N_ N173D_ Q295N | 308 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAACAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAGACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTAACGTGGCCTGCTGAAAGCGTTTGACTCTTTGGAAGATTAATGA |
| K119A_ Q161A_ R228Q | 309 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGGCGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCAGCTGTGCTTTGCGGTGATCAGCAACGATCCGACGCTGGTTCCG AGCAGCGATGAAGGCGACATCGAGAAATTTCATAACTATGCAACTAAAGCGCCGTACGCCTATGTCGGTGAG AAGCGCACGCTGGTGTACGGTCTGACCCTGAGCCCGAAAGAAGAGTACTATAAGCTGGGCGCGTACTACCAC ATTACCGACGTTCAACGTGGCCTGCTGAAAGCGTTTGACTCTTTGGAAGATTAATGA |
| Q38G_ E112D_ F123H | 310 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGGTGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGACGTCACGGGCGGTTTCAAAAAGACCTAT GCTCACTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCCTGCTGAAAGCGTTTGACTCTTTGGAAGATTAATGA |
| V49A_ S177Y_ C209G | 311 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG CGTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCTACGAGCTGTCTGCACAGACGCTCGAAGCGGAGTCCGTTTTGGCACTGGTGCG TGAGTTGGGTCTGCACGTTCCGAATGAATTGGGTCTGAAATTCGGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTAACGTGGCCTGCTGAAAGCGTTTGACTCTTTGGAAGATTAATGA |
| K118N_ K119A_ V271E | 312 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAACGCGACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACCTGTATTTCAGCGAGCTGTCTGCACAGACGCTCGAAGCGGAGTCCGTTTTGGCACTGGTGCG |
| | | TGAGTTGGGTCTGCACGTTCCGAATGAATTGGGTCTGAAATTCTGCAAGCGTAGCTTTAGCGTTTACCCGACC |
| | | CTGAACTGGGAAACCGGCAAGATTGACCGCCTGTGCTTTGCGGTGATCAGCAACGATCCGACGCTGGTTCCGA |
| | | GCAGCGATGAAGGCGACATCGAGAAATTTCATAACTATGCAACTAAAGCGCCGTACGCCTATGTCGGTGAGA |
| | | AGCGCACGCTGGAGTACGGTCTGACCCTGAGCCCGAAAGAAGAGTACTATAAGCTGGGCGCGTACTACCACA |
| | | TTACCGACGTTCAACGTGGCCTGCTGAAAGCGTTTGACTCTTTGGAAGATTAATGA |
| L174V_ C230N_ L298Q | 313 | ATGAGCGAAGCGGCGGACGTCGAACGTGTTTATGCAGCGATGGAAGAAGCAGCCGGTTTGCTGGGTGTGGCT |
| | | TGTGCGCGTGATAAGATTTATCCACTGCTGAGCACTTTTCAAGACACGCTGGTCGAGGGTGGCTCGGTGGTCG |
| | | TTTTTAGCATGGCTAGCGGTCGCCACAGCACCGAGCTGGACTTCTCCATCTCCGTCCCGACCAGCCACGGTGA |
| | | TCCTTACGCCACCGTTGTGGAGAAAGGTCTGTTCCCGGCGACCGGCCACCCGGTCGACGATCTGCTGGCCGAC |
| | | ACGCAAAAGCATCTGCCGGTGAGCATGTTCGCAATTGATGGTGAGGTCACGGGCGGTTTCAAAAAGACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACGTTTATTTCAGCGAGCTGTCTGCACAGACGCTCGAAGCGGAGTCCGTTTTGGCACTGGTGCG |
| | | TGAGTTGGGTCTGCACGTTCCGAATGAATTGGGTCTGAAATTCTGCAAGCGTAGCTTTAGCGTTTACCCGACC |
| | | CTGAACTGGGAAACCGGCAAGATTGACCGCCTGAACTTTGCGGTGATCAGCAACGATCCGACGCTGGTTCCG |
| | | AGCAGCGATGAAGGCGACATCGAGAAATTTCATAACTATGCAACTAAAGCGCCGTACGCCTATGTCGGTGAG |
| | | AAGCGCACGCTGGTGTACGGTCTGACCCTGAGCCCGAAAGAAGAGTACTATAAGCTGGGCGCGTACTACCAC |
| | | ATTACCGACGTTCAACGTGGCCAGCTGAAAGCGTTTGACTCTTTGGAAGATTAATGA |
| K119D_ S177E_ L219F | 314 | ATGAGCGAAGCGGCGGACGTCGAACGTGTTTATGCAGCGATGGAAGAAGCAGCCGGTTTGCTGGGTGTGGCT |
| | | TGTGCGCGTGATAAGATTTATCCACTGCTGAGCACTTTTCAAGACACGCTGGTCGAGGGTGGCTCGGTGGTCG |
| | | TTTTTAGCATGGCTAGCGGTCGCCACAGCACCGAGCTGGACTTCTCCATCTCCGTCCCGACCAGCCACGGTGA |
| | | TCCTTACGCCACCGTTGTGGAGAAAGGTCTGTTCCCGGCGACCGGCCACCCGGTCGACGATCTGCTGGCCGAC |
| | | ACGCAAAAGCATCTGCCGGTGAGCATGTTCGCAATTGATGGTGAGGTCACGGGCGGTTTCAAAGACACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACCTGTATTTCGAGGAGCTGTCTGCACAGACGCTCGAAGCGGAGTCCGTTTTGGCACTGGTGCG |
| | | TGAGTTGGGTCTGCACGTTCCGAATGAATTGGGTCTGAAATTCTGCAAGCGTAGCTTTAGCGTTTACCCGACC |
| | | TTCAACTGGGAAACCGGCAAGATTGACCGCCTGTGCTTTGCGGTGATCAGCAACGATCCGACGCTGGTTCCGA |
| | | GCAGCGATGAAGGCGACATCGAGAAATTTCATAACTATGCAACTAAAGCGCCGTACGCCTATGTCGGTGAGA |
| | | AGCGCACGCTGGTGTACGGTCTGACCCTGAGCCCGAAAGAAGAGTACTATAAGCTGGGCGCGTACTACCACA |
| | | TTACCGACGTTCAACGTGGCCTGCTGAAAGCGTTTGACTCTTTGGAAGATTAATGA |
| A53E_ E112G_ R228E | tag | ATGAGCGAAGCGGCGGACGTCGAACGTGTTTATGCAGCGATGGAAGAAGCAGCCGGTTTGCTGGGTGTGGCT |
| | | TGTGCGCGTGATAAGATTTATCCACTGCTGAGCACTTTTCAAGACACGCTGGTCGAGGGTGGCTCGGTGGTCG |
| | | TTTTTAGCATGGAGAGCGGTCGCCACAGCACCGAGCTGGACTTCTCCATCTCCGTCCCGACCAGCCACGGTGA |
| | | TCCTTACGCCACCGTTGTGGAGAAAGGTCTGTTCCCGGCGACCGGCCACCCGGTCGACGATCTGCTGGCCGAC |
| | | ACGCAAAAGCATCTGCCGGTGAGCATGTTCGCAATTGATGGTGGTGTCACGGGCGGTTTCAAAAAGACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACCTGTATTTCAGCGAGCTGTCTGCACAGACGCTCGAAGCGGAGTCCGTTTTGGCACTGGTGCG |
| | | TGAGTTGGGTCTGCACGTTCCGAATGAATTGGGTCTGAAATTCTGCAAGCGTAGCTTTAGCGTTTACCCGACC |
| | | CTGAACTGGGAAACCGGCAAGATTGACGAGCTGTGCTTTGCGGTGATCAGCAACGATCCGACGCTGGTTCCG |
| | | AGCAGCGATGAAGGCGACATCGAGAAATTTCATAACTATGCAACTAAAGCGCCGTACGCCTATGTCGGTGAG |
| | | AAGCGCACGCTGGTGTACGGTCTGACCCTGAGCCCGAAAGAAGAGTACTATAAGCTGGGCGCGTACTACCAC |
| | | ATTACCGACGTTCAACGTGGCCTGCTGAAAGCGTTTGACTCTTTGGAAGATTAATGA |
| A53E_ F213M_ R228Q | 316 | ATGAGCGAAGCGGCGGACGTCGAACGTGTTTATGCAGCGATGGAAGAAGCAGCCGGTTTGCTGGGTGTGGCT |
| | | TGTGCGCGTGATAAGATTTATCCACTGCTGAGCACTTTTCAAGACACGCTGGTCGAGGGTGGCTCGGTGGTCG |
| | | TTTTTAGCATGGAGAGCGGTCGCCACAGCACCGAGCTGGACTTCTCCATCTCCGTCCCGACCAGCCACGGTGA |
| | | TCCTTACGCCACCGTTGTGGAGAAAGGTCTGTTCCCGGCGACCGGCCACCCGGTCGACGATCTGCTGGCCGAC |
| | | ACGCAAAAGCATCTGCCGGTGAGCATGTTCGCAATTGATGGTGAGGTCACGGGCGGTTTCAAAAAGACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACCTGTATTTCAGCGAGCTGTCTGCACAGACGCTCGAAGCGGAGTCCGTTTTGGCACTGGTGCG |
| | | TGAGTTGGGTCTGCACGTTCCGAATGAATTGGGTCTGAAATTCTGCAAGCGTAGCATGAGCGTTTACCCGACC |
| | | CTGAACTGGGAAACCGGCAAGATTGACCAGCTGTGCTTTGCGGTGATCAGCAACGATCCGACGCTGGTTCCG |
| | | AGCAGCGATGAAGGCGACATCGAGAAATTTCATAACTATGCAACTAAAGCGCCGTACGCCTATGTCGGTGAG |
| | | AAGCGCACGCTGGTGTACGGTCTGACCCTGAGCCCGAAAGAAGAGTACTATAAGCTGGGCGCGTACTACCAC |
| | | ATTACCGACGTTCAACGTGGCCTGCTGAAAGCGTTTGACTCTTTGGAAGATTAATGA |
| A53Q_ S177W_ L219F | 317 | ATGAGCGAAGCGGCGGACGTCGAACGTGTTTATGCAGCGATGGAAGAAGCAGCCGGTTTGCTGGGTGTGGCT |
| | | TGTGCGCGTGATAAGATTTATCCACTGCTGAGCACTTTTCAAGACACGCTGGTCGAGGGTGGCTCGGTGGTCG |
| | | TTTTTAGCATGGCAGAGCGGTCGCCACAGCACCGAGCTGGACTTCTCCATCTCCGTCCCGACCAGCCACGGTGA |
| | | TCCTTACGCCACCGTTGTGGAGAAAGGTCTGTTCCCGGCGACCGGCCACCCGGTCGACGATCTGCTGGCCGAC |
| | | ACGCAAAAGCATCTGCCGGTGAGCATGTTCGCAATTGATGGTGAGGTCACGGGCGGTTTCAAAAAGACCTAT |
| | | GCTTTCTTTCCGACCGACAATATGCCTGGCGTTGCGGAGCTGAGCGCGATCCCGTCTATGCCGCCAGCGGTGG |
| | | CCGAGAATGCAGAGCTGTTCGCTCGTTACGGTCTGGATAAGGTGCAGATGACCAGCATGGATTACAAGAAAC |
| | | GCCAGGTAAACCTGTATTTCTGGGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123A_<br>Y283L | 318 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCC<br>TGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTGCGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACCTGAAGCTGGGCGCGTACTACCACA<br>TTACCGACGTTCAACGTGGCCTGCTGAAAGCGTTTGACTCTTTGGAAGATTAATGA |
| C25V_<br>Y121W_<br>M162F | 319 | ATGAGCGAAGCGGCGGACGTCGAACGTGTTTATGCAGCGATGGAAGAAGCAGCCGGTTTGCTGGGTGTGGCT<br>GTTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTGG<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGTTCACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V49L_<br>S214R_<br>V271E | 320 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCC<br>TGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTCGTGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGAGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| D227E_<br>C230N_<br>Q295W | 321 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGAGCGCCTGAACTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTTGGCGTGGCCTGCTGAAAGCGTTTGACTCTTTGGAAGATTAATGA |
| G205L_<br>Y216A_<br>C230S | 322 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGCTGCTGAAATTCTGCAAGCGTAGCTTTAGCGTTGCGCCGACC<br>CTGAACTGGGAAACCGGCAAGATTGACCGCCTGAGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG |

TABLE 35-continued

Nucleic acid sequences and their SEQ ID NO

| SEQ info | SEQ ID NO | DNA Sequence |
|---|---|---|
| | | AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| Q161S_<br>V294F_<br>L298W | 323 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACTTCAACGTGGCTGGCTGAAAGCGTTTGACTCTTTGGAAGATTAATGA |
| L219F_<br>Y283L_<br>L298W | 324 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTGAAGCTGGGCGCGTACTACCACA<br>TTACCGACGTTCAACGTGGCTGGCTGAAAGCGTTTGACTCTTTGGAAGATTAATGA |
| A17T_<br>F213M_<br>S214R | 325 | ATGAGCGAAGCGGCGGACGTCGAACGTGTTTATGCAGCGATGGAAGAAACCGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCATGCGTGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| L219F_<br>V294N_<br>Q295A | 326 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACAACGCGCGTGGCCTGCTGAAAGCGTTTGACTCTTTGGAAGATTAATGA |
| A53E_<br>A108G_<br>K118N | 327 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| Q38G_ E112G_ M162F | 328 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTGGTGACAGCTGGTCGAGGGTGGCTCGGTGGTCG TTTTTTAGCATGGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGGTGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGTTCACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCCTGCTGAAAGCGTTTGACTCTTTGGAAGATTAATGA |
| A53T_ D166E_ Q295W | 329 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTTAGCATGACCAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGAGTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTTGGCGTGGCCTGCTGAAAGCGTTTGACTCTTTGGAAGATTAATGA |
| L174V_ C230S_ V294A | 330 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTTAGCATGGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACGTTTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGAGCTTTGCGGTGATCAGCAACGATCCGACGCTGGTTCCG AGCAGCGATGAAGGCGACATCGAGAAATTTCATAACTATGCAACTAAAGCGCCGTACGCCTATGTCGGTGAG AAGCGCACGCTGGTGTACGGTCTGACCCTGAGCCCGAAAGAAGAGTACTATAAGCTGGGCGCGTACTACCAC ATTACCGACGCGCAACGTGGCCTGCTGAAAGCGTTTGACTCTTTGGAAGATTAATGA |
| M106E_ G286E_ L298W | 331 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTGGTGACAGCTGGTCGAGGGTGGCTCGGTGGTCG TTTTTTAGCATGGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCGAGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGAGGCGTACTACCACA TTACCGACGTTCAACGTGGCTGGCTGAAAGCGTTTGACTCTTTGGAAGATTAATGA |
| D227E_ R228E_ L298Q | 332 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTTAGCATGGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGAGGAGCTGTGCTTTGCGGTGATCAGCAACGATCCGACGCTGGTTCCG AGCAGCGATGAAGGCGACATCGAGAAATTTCATAACTATGCAACTAAAGCGCCGTACGCCTATGTCGGTGAG AAGCGCACGCTGGTGTACGGTCTGACCCTGAGCCCGAAAGAAGAGTACTATAAGCTGGGCGCGTACTACCAC ATTACCGACGTTCAACGTGGCCAGCTGAAAGCGTTTGACTCTTTGGAAGATTAATGA |
| M162A_ C209G_ Y288H | 333 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTTAGCATGGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCGGTAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGCACTACCACA<br>TTACCGACGTTAACGTGGCCTGCTGAAAGCGTTTGACTCTTTGGAAGATTAATGA |
| A17T_<br>C25V_<br>E112G | 334 | ATGAGCGAAGCGGCGGACGTCGAACGTGTTTATGCAGCGATGGAAGAAACCGCCGGTTTGCTGGGTGTGGCT<br>GTTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| A53Q_<br>Y121W_<br>A232S | 335 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTGG<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| A53Q_<br>S177Y_<br>Y288H | 336 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGCACTACCACA<br>TTACCGACGTTAACGTGGCCTGCTGAAAGCGTTTGACTCTTTGGAAGATTAATGA |
| F123H_<br>L274V_<br>L298A | 337 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTGTTACCCTGAGCCCGAAAGAAGAGTACTATAAGCTGGGCGCGTACTACCACA<br>TTACCGACGTTAACGTGGCGCGCTGAAAGCGTTTGACTCTTTGGAAGATTAATGA |
| S177W_<br>S214F_<br>Y283L | 338 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTGGGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACCTGAAGCTGGGCGCGTACTACCACA<br>TTACCGACGTTCAACGTGGCCTGCTGAAAGCGTTTGACTCTTTGGAAGATTAATGA |
| A53E_<br>G205M_<br>L274V | 339 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTGTTACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>K118N_<br>S214F | 340 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| S177E_<br>S214R_<br>R228E | 341 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTCGTGTTTACCCGACCC<br>TGAACTGGGAAACCGGCAAGATTGACGAGCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K118Q_<br>S177Y_<br>D227E | 342 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCCAGAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGAGCGCCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| D166E_<br>S177Y_<br>S214F | 343 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161A_<br>M162F_<br>Q295A | 344 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGCGTTCACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTGCGCGTGGCCTGCTGAAAGCGTTTGACTCTTTGGAAGATTAATGA |
| A53E_<br>Q161A_<br>V294N | 345 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGCGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACAACCAACGTGGCCTGCTGAAAGCGTTTGACTCTTTGGAAGATTAATGA |
| A108G_<br>F123W_<br>V294A | 346 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAAAGACCTAT<br>GCTTGGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGAACTGGCCTGCTGAAAGCGTTTGACTCTTTGGAAGATTAATGA |
| A53Q_<br>G205L_<br>Q295N | 347 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGCTGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACCGTGGCCTGCTGAAAGCGTTTGACTCTTTGGAAGATTAATGA |
| K118Q_<br>F123A_<br>R228E | 348 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCCAGAAGACCTAT<br>GCTGCGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGCGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACGAGCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| V49L_<br>E112D_<br>G286E | 349 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCC<br>TGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGACGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGAGGCGTACTACCACA<br>TTACCGACGTTCAACGTGGCCTGCTGAAAGCGTTTGACTCTTTGGAAGATTAATGA |
| G205L_<br>R228E_<br>C230N | 350 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGACGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGCTGCTGAAATTCTGCAAGCGTAGCTTTAGCGTTTACCCGACC<br>CTGAACTGGGAAACCGGCAAGATTGACGAGCTGAACTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| M162A_<br>D227E_<br>C230S | 351 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGAGCGCCTGAGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| V49L_<br>K119D_<br>G205M | 352 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCC<br>TGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAGACACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K119A_<br>S214G_<br>L298A | 353 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAGACACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTGGTGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCGCGCTGAAAGCGTTTGACTCTTTGGAAGATTAATGA |
| Q38G_<br>Y216A_<br>A232S | 354 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTGGTGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
| --- | --- | --- |
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTGCGCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| Q161A_<br>V271E_<br>Q295W | 355 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGAGTACGGTCTGACCCTGAGCCCGAAAGAAGAGTACTATAAGCTGGGCGCGTACTACCACA<br>TTACCGACGTTTGGCGTGGCCTGCTGAAAGCGTTTGACTCTTTGGAAGATTAATGA |
| V49S_<br>Y216A_<br>V294N | 356 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCA<br>GCTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTGCGCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACAACCAACGTGGCCTGCTGAAAGCGTTTGACTCTTTGGAAGATTAATGA |
| F123A_<br>M162F_<br>S214G | 357 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTGCGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGTTCACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTGGTGTTTACCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| C25V_<br>A232S_<br>V271E | 358 | ATGAGCGAAGCGGCGGACGTCGAACGTGTTTATGCAGCGATGGAAGAAGCAGCCGGTTTGCTGGGTGTGGCT<br>GTTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGAGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| K118Q_<br>L174V_<br>R228Q | 359 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCCAGAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCAGCTGTGTCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| V49S_<br>S214G_<br>V294A | 360 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCA<br>GCTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGAACGTGGCCTGCTGAAAGCGTTTGACTCTTTGGAAGATTAATGA |
| E112D_<br>K119A_<br>N173D | 361 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGACGTCACGGGCGGTTTCAAAGCGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAGACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123W_<br>Q161W_<br>D227E | 362 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTGGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGAGCGCCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| A53T_<br>N173D_<br>S214R | 363 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAGACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTCGTGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123W_<br>M162F_<br>C209G | 364 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTGGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGTTCACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCGGTAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| M106E_<br>M162A_<br>Y216A | 365 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCGAGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTGCGCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V49A_<br>Q161S_<br>V294A | 366 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGCAACGTGGCCTGCTGAAAGCGTTTGACTCTTTGGAAGATTAATGA |
| C25V_<br>F213M_<br>Y216A | 367 | ATGAGCGAAGCGGCGGACGTCGAACGTGTTTATGCAGCGATGGAAGAAGCAGCCGGTTTGCTGGGTGTGGCT<br>GTTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTGCGCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A108G_<br>K119D_<br>L298A | 368 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAGACACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCGCGCTGAAAGCGTTTGACTCTTTGGAAGATTAATGA |
| K118N_<br>C209G_<br>R228Q | 369 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCGGTAAGCGTAGCTTTAGCGTTTACCCGACC<br>CTGAACTGGGAAACCGGCAAGATTGACCAGCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| A53T_ M106E_ Q161S | 370 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGACCAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCGAGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGAGCATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCCTGCTGAAAGCGTTTGACTCTTTGGAAGATTAATGA |
| Q38G_ D166E_ Q295A | 371 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTGGTGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGAGTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTGCGCGTGGCCTGCTGAAAGCGTTTGACTCTTTGGAAGATTAATGA |
| M106E_ G205L_ C209G | 372 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCGAGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGCTGCTGAAATTCGGTAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCCTGCTGAAAGCGTTTGACTCTTTGGAAGATTAATGA |
| E112G_ G205M_ L298W | 373 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGGTGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCAGCGAGCTGTCTGCACAGACGCTCGAAGCGGAGTCCGTTTTGGCACTGGTGCG TGAGTTGGGTCTGCACGTTCCGAATGAATTGATGCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCTGGCTGAAAGCGTTTGACTCTTTGGAAGATTAATGA |
| V49S_ K118Q_ S177E | 374 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCA GCTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAGAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGCAGATGACCAGCATGGATTACAAGAAAC GCCAGGTAAACCTGTATTTCGAGGAGCTGTCTGCACAGACGCTCGAAGCGGAGTCCGTTTTGGCACTGGTGCG TGAGTTGGGTCTGCACGTTCCGAATGAATTGGGTCTGAAATTCTGCAAGCGTAGCTTTAGCGTTTACCCGACC CTGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTCAACGTGGCCTGCTGAAAGCGTTTGACTCTTTGGAAGATTAATGA |
| M106E_ Y121W_ D166E | 375 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGGCTAGCGGTCGCCACAGCACCGAGCTGGACTTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCGAGTTCGCAATTGATGGTGAGGTCACGGGCGGTTTCAAAAAGACCTGG
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGAGTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTAGCGTTTACCCGACC
CTGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTCTGACCCTGAGCCCGAAAGAAGAGTACTATAAGCTGGGCGCGTACTACCACA
TTACCGACGTTCAACGTGGCCTGCTGAAAGCGTTTGACTCTTTGGAAGATTAATGA |
| A53Q_ L274V_ Q295A | 376 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGCAGAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTAGCGTTTACCCGACC
CTGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTGTTACCCTGAGCCCGAAAGAAGAGTACTATAAGCTGGGCGCGTACTACCACA
TTACCGACGTTGCGCGTGGCCTGCTGAAAGCGTTTGACTCTTTGGAAGATTAATGA |
| V49A_ F123A_ Y288H | 377 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
CGTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTGCGTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTAGCGTTTACCCGACC
CTGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTCTGACCCTGAGCCCGAAAGAAGAGTACTATAAGCTGGGCGCGCACTACCACA
TTACCGACGTTCAACGTGGCCTGCTGAAAGCGTTTGACTCTTTGGAAGATTAATGA |
| C25V_ F123H_ Q295N | 378 | ATGAGCGAAGCGGCGGACGTCGAACGTGTTTATGCAGCGATGGAAGAAGCAGCCGGTTTGCTGGGTGTGGCT
GTTGCGCGTGATAAGATTTATCCACTGCTGAGCACTTTTCAAGACACGCTGGTCGAGGGTGGCTCGGTGGTCG
TTTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTCACTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTAGCGTTTACCCGACC
CTGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTCTGACCCTGAGCCCGAAAGAAGAGTACTATAAGCTGGGCGCGTACTACCACA
TTACCGACGTTAACCGTGGCCTGCTGAAAGCGTTTGACTCTTTGGAAGATTAATGA |
| K119D_ Q161W_ L298Q | 379 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAGACACCTAT
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGTGGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTAGCGTTTACCCGACC
CTGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTCTGACCCTGAGCCCGAAAGAAGAGTACTATAAGCTGGGCGCGTACTACCACA
TTACCGACGTTCAACGTGGCCAGCTGAAAGCGTTTGACTCTTTGGAAGATTAATGA |
| V49A_ Y121W_ C230S | 380 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
CGTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTGG
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGAGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| M162A_<br>N173D_<br>S214F | 381 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAGACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V49L_<br>D166E_<br>L274V | 382 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCC<br>TGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTGTTACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V49S_<br>K119D_<br>F213M | 383 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCA<br>GCTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCATGAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| E112D_<br>L219F_<br>V294F | 384 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGACGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACTTCCAACGTGGCCTGCTGAAAGCGTTTGACTCTTTGGAAGATTAATGA |
| F123H_<br>L174V_<br>S177E | 385 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| E112G_<br>F123H_<br>S214G | 386 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGGTGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTGGTGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123A_<br>S177W_<br>G205L | 387 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTGCGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTGGGAGCTGTCTGCACAGACGCTCGAAGCGGAGTCCGTTTTGGCACTGGTGCG<br>TGAGTTGGGTCTGCACGTTCCGAATGAATTGCTGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| S177W_<br>Y288H_<br>V294N | 388 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTGGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGCACTACCACA<br>TTACCGACAACCAACGTGGCCTGCTGAAAGCGTTTGACTCTTTGGAAGATTAATGA |
| A108G_<br>Q161S_<br>G205M | 389 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Y121W_<br>S177Y_<br>G286E | 390 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTGG<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGAGGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| A17T_ F123W_ L298A | 391 | ATGAGCGAAGCGGCGGACGTCGAACGTGTTTATGCAGCGATGGAAGAAACCGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTGGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCGCGCTGAAAGCGTTTGACTCTTTGGAAGATTAATGA |
| N173D_ F213M_ V294F | 392 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAGACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCATGAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACTTCCAACGTGGCCTGCTGAAAGCGTTTGACTCTTTGGAAGATTAATGA |
| A53T_ E112D_ G205M | 393 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGACGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q38G_ L174V_ S214R | 394 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTCGTGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A17T_ V49A_ C230N | 395 | ATGAGCGAAGCGGCGGACGTCGAACGTGTTTATGCAGCGATGGAAGAAACCGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGAACTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| A17T_ Q161W_ A232S | 396 | ATGAGCGAAGCGGCGGACGTCGAACGTGTTTATGCAGCGATGGAAGAAACCGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161W_<br>R228Q_<br>Q295W | 397 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCAGCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTTGGCGTGGCCTGCTGAAAGCGTTTGACTCTTTGGAAGATTAATGA |
| Y288A | 398 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGgcaTACCACAT<br>TACCGACGTTCAACGTGGCCTGCTGAAAGCGTTTGACTCTTTGGAAGATTAATGA |
| Y288C | 399 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGtgtTACCACATT<br>ACCGACGTTCAACGTGGCCTGCTGAAAGCGTTTGACTCTTTGGAAGATTAATGA |
| Y288D | 400 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGgatTACCACAT<br>TACCGACGTTCAACGTGGCCTGCTGAAAGCGTTTGACTCTTTGGAAGATTAATGA |
| Y288E | 401 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGgaaTACCACAT<br>TACCGACGTTCAACGTGGCCTGCTGAAAGCGTTTGACTCTTTGGAAGATTAATGA |
| Y288F | 402 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGtttTACCACATT<br>ACCGACGTTCAACGTGGCCTGCTGAAAGCGTTTGACTCTTTGGAAGATTAATGA |
| Y288G | 403 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGggtTACCACAT<br>TACCGACGTTCAACGTGGCCTGCTGAAAGCGTTTGACTCTTTGGAAGATTAATGA |
| Y288H | 404 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGcatTACCACATT<br>ACCGACGTTCAACGTGGCCTGCTGAAAGCGTTTGACTCTTTGGAAGATTAATGA |
| Y288I | 405 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGattTACCACATT<br>ACCGACGTTCAACGTGGCCTGCTGAAAGCGTTTGACTCTTTGGAAGATTAATGA |
| Y288K | 406 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGaaaTACCACAT<br>TACCGACGTTCAACGTGGCCTGCTGAAAGCGTTTGACTCTTTGGAAGATTAATGA |
| Y288L | 407 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGctgTACCACAT<br>TACCGACGTTCAACGTGGCCTGCTGAAAGCGTTTGACTCTTTGGAAGATTAATGA |
| Y288M | 408 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGatgTACCACAT<br>TACCGACGTTCAACGTGGCCTGCTGAAAGCGTTTGACTCTTTGGAAGATTAATGA |
| Y288N | 409 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGaatTACCACATT<br>ACCGACGTTCAACGTGGCCTGCTGAAAGCGTTTGACTCTTTGGAAGATTAATGA |
| Y288P | 410 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGccgTACCACAT<br>TACCGACGTTCAACGTGGCCTGCTGAAAGCGTTTGACTCTTTGGAAGATTAATGA |
| Y288Q | 411 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGcagTACCACAT<br>TACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| Y288R | 412 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGcgtTACCACAT<br>TACCGACGTTCAACGTGGCCTGCTGAAAGCGTTTGACTCTTTGGAAGATTAATGA |
| Y288S | 413 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGagcTACCACAT<br>TACCGACGTTCAACGTGGCCTGCTGAAAGCGTTTGACTCTTTGGAAGATTAATGA |
| Y288T | 414 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGaccTACCACAT<br>TACCGACGTTCAACGTGGCCTGCTGAAAGCGTTTGACTCTTTGGAAGATTAATGA |
| Y288V | 415 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGgttTACCACATT<br>ACCGACGTTCAACGTGGCCTGCTGAAAGCGTTTGACTCTTTGGAAGATTAATGA |
| Y288W | 416 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGtggTACCACAT<br>TACCGACGTTCAACGTGGCCTGCTGAAAGCGTTTGACTCTTTGGAAGATTAATGA |
| Y288Y | 417 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGtatTACCACATT<br>ACCGACGTTCAACGTGGCCTGCTGAAAGCGTTTGACTCTTTGGAAGATTAATGA |
| Q161A | 418 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGgcaATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161C | 419 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGtgtATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161D | 420 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGgatATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161E | 421 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGgaaATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161F | 422 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGtttATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG |

TABLE 35-continued

Nucleic acid sequences and their SEQ ID NO

| SEQ info | SEQ ID NO | DNA Sequence |
|---|---|---|
| | | AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161G | 423 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGggtATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161H | 424 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGcatATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161I | 425 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGattATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161K | 426 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGaaaATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161L | 427 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGctgATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161M | 428 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGatgATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161N | 429 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGaatATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161P | 430 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGccgATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161Q | 431 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGcagATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161R | 432 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGcgtATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
| --- | --- | --- |
| Q161S | 433 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161T | 434 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGaccATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161V | 435 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGgttATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161W | 436 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGtggATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161Y | 437 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGtatATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q295A | 438 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgcaCGTGGCCTGCTGAAAGCGTTTGACTCTTTGGAAGATTAATGA |
| Q295C | 439 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTtgtCGTGGCCTGCTGAAAGCGTTTGACTCTTTGGAAGATTAATGA |
| Q295D | 440 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgatCGTGGCCTGCTGAAAGCGTTTGACTCTTTGGAAGATTAATGA |
| Q295E | 441 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgaaCGTGGCCTGCTGAAAGCGTTTGACTCTTTGGAAGATTAATGA |
| Q295F | 442 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTtttCGTGGCCTGCTGAAAGCGTTTGACTCTTTGGAAGATTAATGA |
| Q295G | 443 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTggtCGTGGCCTGCTGAAAGCGTTTGACTCTTTGGAAGATTAATGA |
| Q295H | 444 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTcatCGTGGCCTGCTGAAAGCGTTTGACTCTTTGGAAGATTAATGA |
| Q295I | 445 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTattCGTGGCCTGCTGAAAGCGTTTGACTCTTTGGAAGATTAATGA |
| Q295K | 446 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTaaaCGTGGCCTGCTGAAAGCGTTTGACTCTTTGGAAGATTAATGA |
| Q295L | 447 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTctgCGTGGCCTGCTGAAAGCGTTTGACTCTTTGGAAGATTAATGA |
| Q295M | 448 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGTCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTatgCGTGGCCTGCTGAAAGCGTTTGACTCTTTGGAAGATTAATGA |
| Q295N | 449 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTaatCGTGGCCTGCTGAAAGCGTTTGACTCTTTGGAAGATTAATGA |
| Q295P | 450 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTccgCGTGGCCTGCTGAAAGCGTTTGACTCTTTGGAAGATTAATGA |
| Q295Q | 451 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTcagCGTGGCCTGCTGAAAGCGTTTGACTCTTTGGAAGATTAATGA |
| Q295R | 452 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTcgtCGTGGCCTGCTGAAAGCGTTTGACTCTTTGGAAGATTAATGA |
| Q295S | 453 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTagcCGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| Q295T | 454 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTaccCGTGGCCTGCTGAAAGCGTTTGACTCTTTGGAAGATTAATGA |
| Q295V | 455 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgttCGTGGCCTGCTGAAAGCGTTTGACTCTTTGGAAGATTAATGA |
| Q295W | 456 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTtggCGTGGCCTGCTGAAAGCGTTTGACTCTTTGGAAGATTAATGA |
| Q295Y | 457 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTtatCGTGGCCTGCTGAAAGCGTTTGACTCTTTGGAAGATTAATGA |
| S214A | 458 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTgcaGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTAACGTGGCCTGCTGAAAGCGTTTGACTCTTTGGAAGATTAATGA |
| S214C | 459 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTtgtGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214D | 460 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTgatGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214E | 461 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTgaaGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214F | 462 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTtttGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214G | 463 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTggtGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214H | 464 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTcatGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214I | 465 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTattGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214K | 466 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTaaaGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214L | 467 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTctgGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214M | 468 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTatgGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214N | 469 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTaatGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA |

TABLE 35-continued

Nucleic acid sequences and their SEQ ID NO

| SEQ info | SEQ ID NO | DNA Sequence |
|---|---|---|
| | | GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214P | 470 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTccgGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214Q | 471 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTcagGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214R | 472 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTcgtGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214S | 473 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTagcGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214T | 474 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTaccGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| S214V | 475 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTgtGTTTACCCGACCCT
GAACTGGGAAACCGGCAAGATTGACCGCCTGTGCTTTGCGGTGATCAGCAACGATCCGACGCTGGTTCCGAG
CAGCGATGAAGGCGACATCGAGAAATTTCATAACTATGCAACTAAAGCGCCGTACGCCTATGTCGGTGAGAA
GCGCACGCTGGTGTACGGTCTGACCCTGAGCCCGAAAGAAGAGTACTATAAGCTGGGCGCGTACTACCACAT
TACCGACGTTCAACGTGGCCTGCTGAAAGCGTTTGACTCTTTGGAAGATTAATGA |
| S214W | 476 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTTtggGTTTACCCGACCCT
GAACTGGGAAACCGGCAAGATTGACCGCCTGTGCTTTGCGGTGATCAGCAACGATCCGACGCTGGTTCCGAG
CAGCGATGAAGGCGACATCGAGAAATTTCATAACTATGCAACTAAAGCGCCGTACGCCTATGTCGGTGAGAA
GCGCACGCTGGTGTACGGTCTGACCCTGAGCCCGAAAGAAGAGTACTATAAGCTGGGCGCGTACTACCACAT
TACCGACGTTCAACGTGGCCTGCTGAAAGCGTTTGACTCTTTGGAAGATTAATGA |
| S214Y | 477 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGGCTAGCGGTCGCCACAGCACCGAGCTGGACTTCTCCATCTCCGTCCCGACCAGCCACGGTGA
TCCTTACGCCACCGTTGTGGAGAAAGGTCTGTTCCCGGCGACCGGCCACCCGGTCGACGATCTGCTGGCCGAC
ACGCAAAAGCATCTGCCGGTGAGCATGTTCGCAATTGATGGTGAGGTCACGGGCGGTTTCAAAAAGACCTAT
GCTTTCTTTCCGACCGACAATATGCCTGGCGTTGCGGAGCTGAGCGCGATCCCGTCTATGCCGCCAGCGGTGG
CCGAGAATGCAGAGCTGTTCGCTCGTTACGGTCTGGATAAGGTGCAGATGACCAGCATGGATTACAAGAAAC
GCCAGGTAAACCTGTATTTCAGCGAGCTGTCTGCACAGACGCTCGAAGCGGAGTCCGTTTTGGCACTGGTGCG
TGAGTTGGGTCTGCACGTTCCGAATGAATTGGGTCTGAAATTCTGCAAGCGTAGCTTTtatGTTTACCCGACCCT
GAACTGGGAAACCGGCAAGATTGACCGCCTGTGCTTTGCGGTGATCAGCAACGATCCGACGCTGGTTCCGAG
CAGCGATGAAGGCGACATCGAGAAATTTCATAACTATGCAACTAAAGCGCCGTACGCCTATGTCGGTGAGAA
GCGCACGCTGGTGTACGGTCTGACCCTGAGCCCGAAAGAAGAGTACTATAAGCTGGGCGCGTACTACCACAT
TACCGACGTTCAACGTGGCCTGCTGAAAGCGTTTGACTCTTTGGAAGATTAATGA |
| A53A | 478 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGgcaAGCGGTCGCCACAGCACCGAGCTGGACTTCTCCATCTCCGTCCCGACCAGCCACGGTGAT
CCTTACGCCACCGTTGTGGAGAAAGGTCTGTTCCCGGCGACCGGCCACCCGGTCGACGATCTGCTGGCCGACA
CGCAAAAGCATCTGCCGGTGAGCATGTTCGCAATTGATGGTGAGGTCACGGGCGGTTTCAAAAAGACCTATG
CTTTCTTTCCGACCGACAATATGCCTGGCGTTGCGGAGCTGAGCGCGATCCCGTCTATGCCGCCAGCGGTGGC
CGAGAATGCAGAGCTGTTCGCTCGTTACGGTCTGGATAAGGTGCAGATGACCAGCATGGATTACAAGAAACG
CCAGGTAAACCTGTATTTCAGCGAGCTGTCTGCACAGACGCTCGAAGCGGAGTCCGTTTTGGCACTGGTGCGT
GAGTTGGGTCTGCACGTTCCGAATGAATTGGGTCTGAAATTCTGCAAGCGTAGCTTTAGCGTTTACCCGACCC
TGAACTGGGAAACCGGCAAGATTGACCGCCTGTGCTTTGCGGTGATCAGCAACGATCCGACGCTGGTTCCGA
GCAGCGATGAAGGCGACATCGAGAAATTTCATAACTATGCAACTAAAGCGCCGTACGCCTATGTCGGTGAGA
AGCGCACGCTGGTGTACGGTCTGACCCTGAGCCCGAAAGAAGAGTACTATAAGCTGGGCGCGTACTACCACA
TTACCGACGTTCAACGTGGCCTGCTGAAAGCGTTTGACTCTTTGGAAGATTAATGA |
| A53C | 479 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGtgtAGCGGTCGCCACAGCACCGAGCTGGACTTCTCCATCTCCGTCCCGACCAGCCACGGTGATC
CTTACGCCACCGTTGTGGAGAAAGGTCTGTTCCCGGCGACCGGCCACCCGGTCGACGATCTGCTGGCCGACAC
GCAAAAGCATCTGCCGGTGAGCATGTTCGCAATTGATGGTGAGGTCACGGGCGGTTTCAAAAAGACCTATGC
TTTCTTTCCGACCGACAATATGCCTGGCGTTGCGGAGCTGAGCGCGATCCCGTCTATGCCGCCAGCGGTGGCC
GAGAATGCAGAGCTGTTCGCTCGTTACGGTCTGGATAAGGTGCAGATGACCAGCATGGATTACAAGAAACGC
CAGGTAAACCTGTATTTCAGCGAGCTGTCTGCACAGACGCTCGAAGCGGAGTCCGTTTTGGCACTGGTGCGTG
AGTTGGGTCTGCACGTTCCGAATGAATTGGGTCTGAAATTCTGCAAGCGTAGCTTTAGCGTTTACCCGACCCT
GAACTGGGAAACCGGCAAGATTGACCGCCTGTGCTTTGCGGTGATCAGCAACGATCCGACGCTGGTTCCGAG
CAGCGATGAAGGCGACATCGAGAAATTTCATAACTATGCAACTAAAGCGCCGTACGCCTATGTCGGTGAGAA
GCGCACGCTGGTGTACGGTCTGACCCTGAGCCCGAAAGAAGAGTACTATAAGCTGGGCGCGTACTACCACAT
TACCGACGTTCAACGTGGCCTGCTGAAAGCGTTTGACTCTTTGGAAGATTAATGA |
| A53D | 480 | ATGAGCGAAGCGGCGGACGTCGAACGTGTTTATGCAGCGATGGAAGAAGCAGCCGGTTTGCTGGGTGTGGCT
TGTGCGCGTGATAAGATTTATCCACTGCTGAGCACTTTTCAAGACACGCTGGTCGAGGGTGGCTCGGTGGTCG
TTTTTAGCATGgatAGCGGTCGCCACAGCACCGAGCTGGACTTCTCCATCTCCGTCCCGACCAGCCACGGTGAT
CCTTACGCCACCGTTGTGGAGAAAGGTCTGTTCCCGGCGACCGGCCACCCGGTCGACGATCTGCTGGCCGACA |

TABLE 35-continued

Nucleic acid sequences and their SEQ ID NO

| SEQ info | SEQ ID NO | DNA Sequence |
| --- | --- | --- |
| | | CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53E | 481 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGgaaAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53F | 482 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGtttAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53G | 483 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGggtAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53H | 484 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGcatAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53I | 485 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGattAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG |

TABLE 35-continued

Nucleic acid sequences and their SEQ ID NO

| SEQ info | SEQ ID NO | DNA Sequence |
|---|---|---|
| | | AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53K | 486 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaaaAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53L | 487 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGctgAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53M | 488 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGatgAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53N | 489 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaatAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53P | 490 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGccgAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
| --- | --- | --- |
|  |  | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53Q | 491 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGcagAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53R | 492 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGcgtAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53S | 493 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGagcAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T | 494 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53V | 495 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGgttAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| A53W | 496 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGtggAGCGGTCGCCACAGCACCGAGCTGGACTTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53Y | 497 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGtatAGCGGTCGCCACAGCACCGAGCTGGACTTCTCCATCTCCGTCCCGACCAGCCACGGTGATC<br>CTTACGCCACCGTTGTGGAGAAAGGTCTGTTCCCGGCGACCGGCCACCCGGTCGACGATCTGCTGGCCGACAC<br>GCAAAAGCATCTGCCGGTGAGCATGTTCGCAATTGATGGTGAGGTCACGGGCGGTTTCAAAAAGACCTATGC<br>TTTCTTTCCGACCGACAATATGCCTGGCGTTGCGGAGCTGAGCGCGATCCCGTCTATGCCGCCAGCGGTGGCC<br>GAGAATGCAGAGCTGTTCGCTCGTTACGGTCTGGATAAGGTGCAGATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| V294N | 498 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACCc<br>tgAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACAACcaaCGTGGCCTGCTGAAAGCGTTTGACTCTTTGGAAGATTAATGA |
| L219F_<br>V294N | 499 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACAACcaaCGTGGCCTGCTGAAAGCGTTTGACTCTTTGGAAGATTAATGA |
| L219F_<br>Q295A | 500 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACgttGCGCGTGGCCTGCTGAAAGCGTTTGACTCTTTGGAAGATTAATGA |
| V294N_<br>Q295A | 501 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACCc<br>tgAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACAACGCGCGTGGCCTGCTGAAAGCGTTTGACTCTTTGGAAGATTAATGA |
| L219F | 502 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>TTCAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACgttcaaCGTGGCCTGCTGAAAGCGTTTGACTCTTTGGAAGATTAATGA |
| V49A | 503 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V294A | 504 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGAACGTGGCCTGCTGAAAGCGTTTGACTCTTTGGAAGATTAATGA |
| V49A_V294A | 505 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGAACGTGGCCTGCTGAAAGCGTTTGACTCTTTGGAAGATTAATGA |
| Q161S_V294A | 506 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGCGCAACGTGGCCTGCTGAAAGCGTTTGACTCTTTGGAAGATTAATGA |
| V49A_<br>Q161S | 507 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| S177Y | 508 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTAACGTGGCCTGCTGAAAGCGTTTGACTCTTTGGAAGATTAATGA |
| Y288H | 509 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGCACTACCACA<br>TTACCGACGTTAACGTGGCCTGCTGAAAGCGTTTGACTCTTTGGAAGATTAATGA |
| A53Q_<br>Y288H | 510 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGCACTACCACA<br>TTACCGACGTTAACGTGGCCTGCTGAAAGCGTTTGACTCTTTGGAAGATTAATGA |
| S177Y_<br>Y288H | 511 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGCACTACCACA<br>TTACCGACGTTCAACGTGGCCTGCTGAAAGCGTTTGACTCTTTGGAAGATTAATGA |
| A53Q_<br>S177Y | 512 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTACGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| D166E | 513 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>Q295W | 514 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTTGGCGTGGCCTGCTGAAAGCGTTTGACTCTTTGGAAGATTAATGA |
| D166E_<br>Q295W | 515 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTTGGCGTGGCCTGCTGAAAGCGTTTGACTCTTTGGAAGATTAATGA |
| A53T_<br>D166E | 516 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| F123H | 517 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| L174V | 518 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| S177E | 519 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123H_S177E | 520 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| L174V_S177E | 521 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTTATTTCGAGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123H_L174V | 522 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTCACTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACGTTTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| M106E | 523 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCGAGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>Q161S | 524 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| M106E_<br>Q161S | 525 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCGAGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>M106E | 526 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCGAGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q38G | 527 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTGGTGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| D166E | 528 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q295A | 529 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTGCGCGTGGCCTGCTGAAAGCGTTTGACTCTTTGGAAGATTAATGA |
| Q38G_<br>Q295A | 530 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTGGTGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTGCGCGTGGCCTGCTGAAAGCGTTTGACTCTTTGGAAGATTAATGA |
| D166E_<br>Q295A | 531 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTGCGCGTGGCCTGCTGAAAGCGTTTGACTCTTTGGAAGATTAATGA |
| Q38G_<br>D166E | 532 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTGGTGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGAGTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K118N | 533 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| S214F | 534 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>S214F | 535 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K118N_<br>S214F | 536 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTTTCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>K118N | 537 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGACCAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| S177W | 538 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGgctAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCTGGGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCcT<br>gAACTGGGAAACCGGCAAGATTGACCGCCTGTGCTTTGCGGTGATCAGCAACGATCCGACGCTGGTTCCGAGC<br>AGCGATGAAGGCGACATCGAGAAATTTCATAACTATGCAACTAAAGCGCCGTACGCCTATGTCGGTGAGAAG<br>CGCACGCTGGTGTACGGTCTGACCCTGAGCCCGAAAGAAGAGTACTATAAGCTGGGCGCGTACTACCACATT<br>ACCGACGTTCAACGTGGCCTGCTGAAAGCGTTTGACTCTTTGGAAGATTAATGA |
| L219F | 539 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGgctAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCagcGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCTTC<br>AACTGGGAAACCGGCAAGATTGACCGCCTGTGCTTTGCGGTGATCAGCAACGATCCGACGCTGGTTCCGAGC<br>AGCGATGAAGGCGACATCGAGAAATTTCATAACTATGCAACTAAAGCGCCGTACGCCTATGTCGGTGAGAAG<br>CGCACGCTGGTGTACGGTCTGACCCTGAGCCCGAAAGAAGAGTACTATAAGCTGGGCGCGTACTACCACATT<br>ACCGACGTTCAACGTGGCCTGCTGAAAGCGTTTGACTCTTTGGAAGATTAATGA |
| S177W_<br>L219F | 540 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGgctAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCTGGGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCT<br>TCAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53Q_<br>S177W | 541 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCTGGGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACCc<br>tgAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53Q_<br>L219F | 542 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGCAGAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCagcGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCT<br>TCAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A108G | 543 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGGTATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| G205M | 544 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A108G_<br>G205M | 545 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161S_<br>G205M | 546 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGATGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A108G_<br>Q161S | 547 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGGTATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGAGCATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K118Q | 548 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCCAGAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| M162A | 549 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGGCGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Y283L | 550 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACCTGAAGCTGGGCGCGTACTACCACA<br>TTACCGACGTTCAACGTGGCCTGCTGAAAGCGTTTGACTCTTTGGAAGATTAATGA |
| V271E | 551 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGAGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K119D | 552 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAGACACTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| L274V | 553 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA |

TABLE 35-continued

Nucleic acid sequences and their SEQ ID NO

| SEQ info | SEQ ID NO | DNA Sequence |
|---|---|---|
| | | AGCGCACGCTGGTGTACGGTGTTACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A232S | 554 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTAGCGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Q161A | 555 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGCGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| G205L | 556 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGCTGCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| S214G | 557 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTGGTGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| Y216A | 558 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTGCGCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
| --- | --- | --- |
| N173D | 559 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTCGCAGATGACCAGCATGGATTACAAGAAAC<br>GCCAGGTAGACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123W | 560 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTGGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| K118N | 561 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAACAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| R228Q | 562 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCAGCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| Q161W | 563 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| V294F | 564 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC |

TABLE 35-continued

Nucleic acid sequences and their SEQ ID NO

| SEQ info | SEQ ID NO | DNA Sequence |
|---|---|---|
| | | ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACTTCAACGTGGCCTGCTGAAAGCGTTTGACTCTTTGGAAGATTAATGA |
| S214R | 565 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTCGTGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| G286E | 566 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGAGGCGTACTACCACA<br>TTACCGACGTTCAACGTGGCCTGCTGAAAGCGTTTGACTCTTTGGAAGATTAATGA |
| R228E | 567 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACGAGCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| C230S | 568 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGAGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| D227E | 569 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG |

TABLE 35-continued

Nucleic acid sequences and their SEQ ID NO

| SEQ info | SEQ ID NO | DNA Sequence |
|---|---|---|
| | | TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGAGCGCCTGTGCTTTGCGGTGATCAGCAACGATCCGACGCTGGTTCCG<br>AGCAGCGATGAAGGCGACATCGAGAAATTTCATAACTATGCAACTAAAGCGCCGTACGCCTATGTCGGTGAG<br>AAGCGCACGCTGGTGTACGGTCTGACCCTGAGCCCGAAAGAAGAGTACTATAAGCTGGGCGCGTACTACCAC<br>ATTACCGACGTTCAACGTGGCCTGCTGAAAGCGTTTGACTCTTTGGAAGATTAATGA |
| M162F | 570 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGTTCACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| F123A | 571 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTGCGTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_<br>V294A | 572 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGcgCAACGTGGCCTGCTGAAAGCGTTTGACTCTTTGGAAGATTAATGA |
| A53T_<br>Q161S_<br>V294A | 573 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGcgCAACGTGGCCTGCTGAAAGCGTTTGACTCTTTGGAAGATTAATGA |
| A53T_<br>Q161S_<br>V294Nqq | 574 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA |

TABLE 35-continued

Nucleic acid sequences and their SEQ ID NO

| SEQ info | SEQ ID NO | DNA Sequence |
|---|---|---|
| | | GCGCACGCTGGTGTACGGTCTGACCCTGAGCCCGAAAGAAGAGTACTATAAGCTGGGCGCGTACTACCACAT<br>TACCGACAacCAACGTGGCCTGCTGAAAGCGTTTGACTCTTTGGAAGATTAATGA |
| A53T_<br>Q295A | 575 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgcACGTGGCCTGCTGAAAGCGTTTGACTCTTTGGAAGATTAATGA |
| Q161S_<br>V294A_<br>Q295A | 576 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGcggcaCGTGGCCTGCTGAAAGCGTTTGACTCTTTGGAAGATTAATGA |
| A53T_<br>Q161S_<br>Q295A | 577 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTgcACGTGGCCTGCTGAAAGCGTTTGACTCTTTGGAAGATTAATGA |
| A53T_<br>V294A_<br>Q295A | 578 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGcggcACGTGGCCTGCTGAAAGCGTTTGACTCTTTGGAAGATTAATGA |
| A53T_<br>Q161S_<br>V294A_<br>Q295A | 579 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGcggcACGTGGCCTGCTGAAAGCGTTTGACTCTTTGGAAGATTAATGA |

TABLE 35-continued

Nucleic acid sequences and their SEQ ID NO

| SEQ info | SEQ ID NO | DNA Sequence |
|---|---|---|
| A53T_ Q161S_ V294N_ Q295A | 580 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGaccAGCGGTCGCCACAGCACCGAGCTGGACTTCTCCATCTCCGTCCCGACCAGCCACGGTGAT CCTTACGCCACCGTTGTGGAGAAAGGTCTGTTCCCGGCGACCGGCCACCCGGTCGACGATCTGCTGGCCGACA CGCAAAAGCATCTGCCGGTGAGCATGTTCGCAATTGATGGTGAGGTCACGGGCGGTTTCAAAAAGACCTATG CTTTCTTTCCGACCGACAATATGCCTGGCGTTGCGGAGCTGAGCGCGATCCCGTCTATGCCGCCAGCGGTGGC CGAGAATGCAGAGCTGTTCGCTCGTTACGGTCTGGATAAGGTGagcATGACCAGCATGGATTACAAGAAACGC CAGGTAAACCTGTATTTCAGCGAGCTGTCTGCACAGACGCTCGAAGCGGAGTCCGTTTTGGCACTGGTGCGTG AGTTGGGTCTGCACGTTCCGAATGAATTGGGTCTGAAATTCTGCAAGCGTAGCTTTAGCGTTTACCCGACCCT GAACTGGGAAACCGGCAAGATTGACCGCCTGTGCTTTGCGGTGATCAGCAACGATCCGACGCTGGTTCCGAG CAGCGATGAAGGCGACATCGAGAAATTTCATAACTATGCAACTAAAGCGCCGTACGCCTATGTCGGTGAGAA GCGCACGCTGGTGTACGGTCTGACCCTGAGCCCGAAAGAAGAGTACTATAAGCTGGGCGCGTACTACCACAT TACCGACaacgcACGTGGCCTGCTGAAAGCGTTTGACTCTTTGGAAGATTAATGA |
| A53T_ Q295W | 581 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGaccAGCGGTCGCCACAGCACCGAGCTGGACTTCTCCATCTCCGTCCCGACCAGCCACGGTGAT CCTTACGCCACCGTTGTGGAGAAAGGTCTGTTCCCGGCGACCGGCCACCCGGTCGACGATCTGCTGGCCGACA CGCAAAAGCATCTGCCGGTGAGCATGTTCGCAATTGATGGTGAGGTCACGGGCGGTTTCAAAAAGACCTATG CTTTCTTTCCGACCGACAATATGCCTGGCGTTGCGGAGCTGAGCGCGATCCCGTCTATGCCGCCAGCGGTGGC CGAGAATGCAGAGCTGTTCGCTCGTTACGGTCTGGATAAGGTGCAGATGACCAGCATGGATTACAAGAAACG CCAGGTAAACCTGTATTTCAGCGAGCTGTCTGCACAGACGCTCGAAGCGGAGTCCGTTTTGGCACTGGTGCGT GAGTTGGGTCTGCACGTTCCGAATGAATTGGGTCTGAAATTCTGCAAGCGTAGCTTTAGCGTTTACCCGACCC TGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGTTtggCGTGGCCTGCTGAAAGCGTTTGACTCTTTGGAAGATTAATGA |
| Q161S_ V294A_ Q295W | 582 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGCTAGCGGTCGCCACAGCACCGAGCTGGACTTCTCCATCTCCGTCCCGACCAGCCACGGTGA TCCTTACGCCACCGTTGTGGAGAAAGGTCTGTTCCCGGCGACCGGCCACCCGGTCGACGATCTGCTGGCCGAC ACGCAAAAGCATCTGCCGGTGAGCATGTTCGCAATTGATGGTGAGGTCACGGGCGGTTTCAAAAAGACCTAT GCTTTCTTTCCGACCGACAATATGCCTGGCGTTGCGGAGCTGAGCGCGATCCCGTCTATGCCGCCAGCGGTGG CCGAGAATGCAGAGCTGTTCGCTCGTTACGGTCTGGATAAGGTGagcATGACCAGCATGGATTACAAGAAACG CCAGGTAAACCTGTATTTCAGCGAGCTGTCTGCACAGACGCTCGAAGCGGAGTCCGTTTTGGCACTGGTGCGT GAGTTGGGTCTGCACGTTCCGAATGAATTGGGTCTGAAATTCTGCAAGCGTAGCTTTAGCGTTTACCCGACCC TGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGcgtggCGTGGCCTGCTGAAAGCGTTTGACTCTTTGGAAGATTAATGA |
| A53T_ Q161S_ Q295W | 583 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGaccAGCGGTCGCCACAGCACCGAGCTGGACTTCTCCATCTCCGTCCCGACCAGCCACGGTGAT CCTTACGCCACCGTTGTGGAGAAAGGTCTGTTCCCGGCGACCGGCCACCCGGTCGACGATCTGCTGGCCGACA CGCAAAAGCATCTGCCGGTGAGCATGTTCGCAATTGATGGTGAGGTCACGGGCGGTTTCAAAAAGACCTATG CTTTCTTTCCGACCGACAATATGCCTGGCGTTGCGGAGCTGAGCGCGATCCCGTCTATGCCGCCAGCGGTGGC CGAGAATGCAGAGCTGTTCGCTCGTTACGGTCTGGATAAGGTGagcATGACCAGCATGGATTACAAGAAACGC CAGGTAAACCTGTATTTCAGCGAGCTGTCTGCACAGACGCTCGAAGCGGAGTCCGTTTTGGCACTGGTGCGTG AGTTGGGTCTGCACGTTCCGAATGAATTGGGTCTGAAATTCTGCAAGCGTAGCTTTAGCGTTTACCCGACCCT GAACTGGGAAACCGGCAAGATTGACCGCCTGTGCTTTGCGGTGATCAGCAACGATCCGACGCTGGTTCCGAG CAGCGATGAAGGCGACATCGAGAAATTTCATAACTATGCAACTAAAGCGCCGTACGCCTATGTCGGTGAGAA GCGCACGCTGGTGTACGGTCTGACCCTGAGCCCGAAAGAAGAGTACTATAAGCTGGGCGCGTACTACCACAT TACCGACGTTtggCGTGGCCTGCTGAAAGCGTTTGACTCTTTGGAAGATTAATGA |
| A53T_ V294A_ Q295W | 584 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGaccAGCGGTCGCCACAGCACCGAGCTGGACTTCTCCATCTCCGTCCCGACCAGCCACGGTGAT CCTTACGCCACCGTTGTGGAGAAAGGTCTGTTCCCGGCGACCGGCCACCCGGTCGACGATCTGCTGGCCGACA CGCAAAAGCATCTGCCGGTGAGCATGTTCGCAATTGATGGTGAGGTCACGGGCGGTTTCAAAAAGACCTATG CTTTCTTTCCGACCGACAATATGCCTGGCGTTGCGGAGCTGAGCGCGATCCCGTCTATGCCGCCAGCGGTGGC CGAGAATGCAGAGCTGTTCGCTCGTTACGGTCTGGATAAGGTGCAGATGACCAGCATGGATTACAAGAAACG CCAGGTAAACCTGTATTTCAGCGAGCTGTCTGCACAGACGCTCGAAGCGGAGTCCGTTTTGGCACTGGTGCGT GAGTTGGGTCTGCACGTTCCGAATGAATTGGGTCTGAAATTCTGCAAGCGTAGCTTTAGCGTTTACCCGACCC TGAACTGGGAAACCGGCAAGATTGACCGCCTGTGCTTTGCGGTGATCAGCAACGATCCGACGCTGGTTCCGA GCAGCGATGAAGGCGACATCGAGAAATTTCATAACTATGCAACTAAAGCGCCGTACGCCTATGTCGGTGAGA AGCGCACGCTGGTGTACGGTCTGACCCTGAGCCCGAAAGAAGAGTACTATAAGCTGGGCGCGTACTACCACA TTACCGACGcgtggCGTGGCCTGCTGAAAGCGTTTGACTCTTTGGAAGATTAATGA |
| A53T_ Q161S_ V294A_ Q295W | 585 | ATGAGCGAAGCGGCGGACGTCGAACGTGTTTATGCAGCGATGGAAGAAGCAGCCGGTTTGCTGGGTGTGGCT TGTGCGCGTGATAAGATTTATCCACTGCTGAGCACTTTTCAAGACACGCTGGTCGAGGGTGGCTCGGTGGTCG TTTTTAGCATGaccAGCGGTCGCCACAGCACCGAGCTGGACTTCTCCATCTCCGTCCCGACCAGCCACGGTGAT CCTTACGCCACCGTTGTGGAGAAAGGTCTGTTCCCGGCGACCGGCCACCCGGTCGACGATCTGCTGGCCGACA |

TABLE 35-continued

Nucleic acid sequences and their SEQ ID NO

| SEQ info | SEQ ID NO | DNA Sequence |
|---|---|---|
| | | CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGcgtggCGTGGCCTGCTGAAAGCGTTTGACTCTTTGGAAGATTAATGA |
| A53T_<br>Q161S_<br>V294N_<br>Q295W | 586 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACaactggCGTGGCCTGCTGAAAGCGTTTGACTCTTTGGAAGATTAATGA |
| S177W_<br>Q295 | 587 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCtGgGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTgcaCGTGGCCTGCTGAAAGCGTTTGACTCTTTGGAAGATTAATGA |
| S177W_<br>S214R | 588 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCtGgGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTcgtGTTTACCCGACCCTG<br>AACTGGGAAACCGGCAAGATTGACCGCCTGTGCTTTGCGGTGATCAGCAACGATCCGACGCTGGTTCCGAGC<br>AGCGATGAAGGCGACATCGAGAAATTTCATAACTATGCAACTAAAGCGCCGTACGCCTATGTCGGTGAGAAG<br>CGCACGCTGGTGTACGGTCTGACCCTGAGCCCGAAAGAAGAGTACTATAAGCTGGGCGCGTACTACCACATT<br>ACCGACGTTCAACGTGGCTGCTGAAAGCGTTTGACTCTTTGGAAGATTAATGA |
| Q161S_<br>S177W | 589 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCtGgGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53T_<br>S177W | 590 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCtGgGAGCTGTCTGCACAGACGCTCGAAGCGGAGTCCGTTTTGGCACTGGTGCGTG |

TABLE 35-continued

Nucleic acid sequences and their SEQ ID NO

| SEQ info | SEQ ID NO | DNA Sequence |
|---|---|---|
| | | AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| V49A_Q295L | 591 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTAGCGTTTACCCGACC<br>CTGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCtgCGTGGCCTGCTGAAAGCGTTTGACTCTTTGGAAGATTAATGA |
| V49A_S214R | 592 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTcGtGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |
| A53T_Q295F | 593 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTMCGTGGCCTGCTGAAAGCGTTTGACTCTTTGGAAGATTAATGA |
| A53T_S214R | 594 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGCAGATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTcGtGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| A53T_A161S | 595 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGaccAGCGGTCGCCACAGCACCGAGCTGGACTTCTCCATCTCCGTCCCGACCAGCCACGGTGAT<br>CCTTACGCCACCGTTGTGGAGAAAGGTCTGTTCCCGGCGACCGGCCACCCGGTCGACGATCTGCTGGCCGACA<br>CGCAAAAGCATCTGCCGGTGAGCATGTTCGCAATTGATGGTGAGGTCACGGGCCGGTTTCAAAAAGACCTATG<br>CTTTCTTTCCGACCGACAATATGCCTGGCGTTGCGGAGCTGAGCGCGATCCCGTCTATGCCGCCAGCGGTGGC<br>CGAGAATGCAGAGCTGTTCGCTCGTTACGGTCTGGATAAGGTGagcATGACCAGCATGGATTACAAGAAACGC<br>CAGGTAAACCTGTATTTCAGCGAGCTGTCTGCACAGACGCTCGAAGCGGAGTCCGTTTTGGCACTGGTGCGTG<br>AGTTGGGTCTGCACGTTCCGAATGAATTGGGTCTGAAATTCTGCAAGCGTAGCTTTAGCGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA |

TABLE 35-continued

Nucleic acid sequences and their SEQ ID NO

| SEQ info | SEQ ID NO | DNA Sequence |
|---|---|---|
| | | GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| Q161S_<br>Q295F | 596 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTMCGTGGCCTGCTGAAAGCGTTTGACTCTTTGGAAGATTAATGA |
| Q161S_<br>Q295L | 597 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCtgCGTGGCCTGCTGAAAGCGTTTGACTCTTTGGAAGATTAATGA |
| Q161S_<br>S214R | 598 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTTcGtAATGAATTGGGTCTGAAATTCTGCAAGCGTAGCTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTCAACGTGGCCTGCTGAAAGCGTTTGACTCTTTGGAAGATTAATGA |
| S214R_<br>Q295F | 599 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>TTTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGCAGATGACCAGCATGGATTACAAGAAAC<br>GCCAGGTAAACCTGTATTTCAGCGAGCTGTCTGCACAGACGCTCGAAGCGGAGTCCGTTTTGGCACTGGTGCG<br>TGAGTTGGGTCTGCACGTTCCGAATGAATTGGGTCTGAAATTCTGCAAGCGTAGCTTTcgtGTTTACCCGACCCT<br>GAACTGGGAAACCGGCAAGATTGACCGCCTGTGCTTTGCGGTGATCAGCAACGATCCGACGCTGGTTCCGAG<br>CAGCGATGAAGGCGACATCGAGAAATTTCATAACTATGCAACTAAAGCGCCGTACGCCTATGTCGGTGAGAA<br>GCGCACGCTGGTGTACGGTCTGACCCTGAGCCCGAAAGAAGAGTACTATAAGCTGGGCGCGTACTACCACAT<br>TACCGACGTTtttCGTGGCCTGCTGAAAGCGTTTGACTCTTTGGAAGATTAATGA |
| V49A_<br>Q161S | 600 | ATGAGCGAAGCGGCGGACGTCGAACGTGTTTATGCAGCGATGGAAGAAGCAGCCGGTTTGCTGGGTGTGGCT<br>TGTGCGCGTGATAAGATTTATCCACTGCTGAGCACTTTTCAAGACACGCTGGTCGAGGGTGGCTCGGTGGTCG<br>CGTTTAGCATGGCTAGCGGTCGCCACAGCACCGAGCTGGACTTCTCCATCTCCGTCCCGACCAGCCACGGTGA<br>TCCTTACGCCACCGTTGTGGAGAAAGGTCTGTTCCCGGCGACCGGCCACCCGGTCGACGATCTGCTGGCCGAC<br>ACGCAAAAGCATCTGCCGGTGAGCATGTTCGCAATTGATGGTGAGGTCACGGGCGGTTTCAAAAAGACCTAT<br>GCTTTCTTTCCGACCGACAATATGCCTGGCGTTGCGGAGCTGAGCGCGATCCCGTCTATGCCGCCAGCGGTGG<br>CCGAGAATGCAGAGCTGTTCGCTCGTTACGGTCTGGATAAGGTGagcATGACCAGCATGGATTACAAGAAACG<br>CCAGGTAAACCTGTATTTCAGCGAGCTGTCTGCACAGACGCTCGAAGCGGAGTCCGTTTTGGCACTGGTGCGT<br>GAGTTGGGTCTGCACGTTCCGAATGAATTGGGTCTGAAATTCTGCAAGCGTAGCTTTAGCGTTTACCCGACCC<br>TGAACTGGGAAACCGGCAAGATTGACCGCCTGTGCTTTGCGGTGATCAGCAACGATCCGACGCTGGTTCCGA<br>GCAGCGATGAAGGCGACATCGAGAAATTTCATAACTATGCAACTAAAGCGCCGTACGCCTATGTCGGTGAGA<br>AGCGCACGCTGGTGTACGGTCTGACCCTGAGCCCGAAAGAAGAGTACTATAAGCTGGGCGCGTACTACCACA<br>TTACCGACGTTCAACGTGGCCTGCTGAAAGCGTTTGACTCTTTGGAAGATTAATGA |

SEQUENCE LISTING (600 sequences)

SEQ ID NO: 1 - protein, 307 aa, Unknown [sequence omitted]

SEQ ID NO: 2 - protein, 307 aa, Artificial Sequence
  ORF2 (NphB) recombinant mutant A108G, Q295N, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGQLKAFDSLED

SEQ ID NO: 3 - protein, 307 aa, Artificial Sequence
  ORF2 (NphB) recombinant mutant K119A, Q161S, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVSMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 4 - protein, 307 aa, Artificial Sequence
  ORF2 (NphB) recombinant mutant V49S, M162A, Y283L
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 5 - protein, 307 aa, Artificial Sequence
  ORF2 (NphB) recombinant mutant K118Q, Q161W, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVWMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 6 - protein, 307 aa, Artificial Sequence
  ORF2 (NphB) recombinant mutant Q161A, S214G, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 7 - protein, 307 aa, Artificial Sequence
  ORF2 (NphB) recombinant mutant F123W, S177W, G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 8 - protein, 307 aa, Artificial Sequence
  ORF2 (NphB) recombinant mutant K118N, N173D, Q295N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 9 - protein, 307 aa, Artificial Sequence
  ORF2 (NphB) recombinant mutant K119A, Q161A, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 10 - protein, 307 aa, Artificial Sequence
  ORF2 (NphB) recombinant mutant Q38G, E112D, F123H
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGDVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 11 - protein, 307 aa, Artificial Sequence
  ORF2 (NphB) recombinant mutant V49A, S177Y, C209G
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 12 - protein, 307 aa, Artificial Sequence
  ORF2 (NphB) recombinant mutant K118N, K119A, V271E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNATYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 13 - protein, 307 aa, Artificial Sequence
  ORF2 (NphB) recombinant mutant L174V, C230N, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLNFAVISNDPTLVPSSDEGDIEKFHNYATKAPYAYVGEKRTLVYGLTLSPKEEYYKLGAYYHITDVQRGQLKAFDSLED

SEQ ID NO: 14 - protein, 307 aa, Artificial Sequence
  ORF2 (NphB) recombinant mutant K119D, S177E, L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 15 - protein, 307 aa, Artificial Sequence
  ORF2 (NphB) recombinant mutant A53E, E112G, R228E
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 16 - protein, 307 aa, Artificial Sequence
  ORF2 (NphB) recombinant mutant A53E, F213M, R228Q
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 17 - protein, 307 aa, Artificial Sequence
  ORF2 (NphB) recombinant mutant A53Q, S177W, L219F
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 18 - protein, 307 aa, Artificial Sequence
  ORF2 (NphB) recombinant mutant F123A, Y283L
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 19 - protein, 307 aa, Artificial Sequence
  ORF2 (NphB) recombinant mutant C25V, Y121W, M162F
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 20 - protein, 307 aa, Artificial Sequence
  ORF2 (NphB) recombinant mutant V49L, S214R, V271E
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 21 - protein, 307 aa, Artificial Sequence
  ORF2 (NphB) recombinant mutant D227E, C230N, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIERLNFAVISNDPTLVPSSDEGDIEKFHNYATKAPYAYVGEKRTLVYGLTLSPKEEYYKLGAYYHITDVWRGLLKAFDSLED

SEQ ID NO: 22 - protein, 307 aa, Artificial Sequence
  ORF2 (NphB) recombinant mutant G205L, Y216A, C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVAPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 23 - protein, 307 aa, Artificial Sequence
  ORF2 (NphB) recombinant mutant Q161S, V294F, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDFQRGWLKAFDSLED

SEQ ID NO: 24 - protein, 307 aa, Artificial Sequence
  ORF2 (NphB) recombinant mutant L219F, Y283L, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYLKLGAYYHITDVQRGWLKAFDSLED

SEQ ID NO: 25 - protein, 307 aa, Artificial Sequence
  ORF2 (NphB) recombinant mutant A17T, F213M, S214R
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 26 - protein, 307 aa, Artificial Sequence
  ORF2 (NphB) recombinant mutant L219F, V294N, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 27 - protein, 307 aa, Artificial Sequence
  ORF2 (NphB) recombinant mutant A53E, A108G, K118N
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFGIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 28 - protein, 307 aa, Artificial Sequence
  ORF2 (NphB) recombinant mutant Q38G, E112G, M162F
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 29 - protein, 307 aa, Artificial Sequence
  ORF2 (NphB) recombinant mutant A53T, D166E, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 30 - protein, 307 aa, Artificial Sequence
  ORF2 (NphB) recombinant mutant L174V, C230S, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDAQRGLLKAFDSLED

SEQ ID NO: 31 - protein, 307 aa, Artificial Sequence
  ORF2 (NphB) recombinant mutant M106E, G286E, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGWLKAFDSLED

SEQ ID NO: 32 - protein, 307 aa, Artificial Sequence
  ORF2 (NphB) recombinant mutant D227E, R228E, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIEELCFAVISNDPTLVPSSDEGDIEKFHNYATKAPYAYVGEKRTLVYGLTLSPKEEYYKLGAYYHITDVQRGQLKAFDSLED

SEQ ID NO: 33 - protein, 307 aa, Artificial Sequence
  ORF2 (NphB) recombinant mutant M162A, C209G, Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 34 - protein, 307 aa, Artificial Sequence
  ORF2 (NphB) recombinant mutant A17T, C25V, E112G
MSEAADVERVYAAMEETAGLLGVAVARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 35 - protein, 307 aa, Artificial Sequence
  ORF2 (NphB) recombinant mutant A53Q, Y121W, A232S
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 36 - protein, 307 aa, Artificial Sequence
  ORF2 (NphB) recombinant mutant A53Q, S177Y, Y288H
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 37 - protein, 307 aa, Artificial Sequence
  ORF2 (NphB) recombinant mutant F123H, L274V, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGALKAFDSLED

SEQ ID NO: 38 - protein, 307 aa, Artificial Sequence
  ORF2 (NphB) recombinant mutant S177W, S214F, Y283L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 39 - protein, 307 aa, Artificial Sequence
  ORF2 (NphB) recombinant mutant A53E, G205M, L274V
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 40 - protein, 307 aa, Artificial Sequence
  ORF2 (NphB) recombinant mutant A53T, K118N, S214F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 41 - protein, 307 aa, Artificial Sequence
  ORF2 (NphB) recombinant mutant S177E, S214R, R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFEELSAQTLEAESVLALVRELGLHVPNELGLKFCKRSFRVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 42 - protein, 307 aa, Artificial Sequence
  ORF2 (NphB) recombinant mutant K118Q, S177Y, D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 43 - protein, 307 aa, Artificial Sequence
  ORF2 (NphB) recombinant mutant D166E, S177Y, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFYELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 44 - protein, 307 aa, Artificial Sequence
  ORF2 (NphB) recombinant mutant Q161A, M162F, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 45 - protein, 307 aa, Artificial Sequence
  ORF2 (NphB) recombinant mutant A53E, Q161A, V294N
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 46 - protein, 307 aa, Artificial Sequence
  ORF2 (NphB) recombinant mutant A108G, F123W, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 47 - protein, 307 aa, Artificial Sequence
  ORF2 (NphB) recombinant mutant A53Q, G205L, Q295N
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 48 - protein, 307 aa, Artificial Sequence
  ORF2 (NphB) recombinant mutant K118Q, F123A, R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 49 - protein, 307 aa, Artificial Sequence
  ORF2 (NphB) recombinant mutant V49L, E112D, G286E
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 50 - protein, 307 aa, Artificial Sequence
  ORF2 (NphB) recombinant mutant G205L, R228E, C230N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDELNFAVISNDPTLVPSSDEGDIEKFHNYATKAPYAYVGEKRTLVYGLTLSPKEEYYKLGAYYHITDVQRGLLKAFDSLED

SEQ ID NO: 51 - protein, 307 aa, Artificial Sequence
  ORF2 (NphB) recombinant mutant M162A, D227E, C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIERLSFAVISNDPTLVPSSDEGDIEKFHNYATKAPYAYVGEKRTLVYGLTLSPKEEYYKLGAYYHITDVQRGLLKAFDSLED

SEQ ID NO: 52 - protein, 307 aa, Artificial Sequence
  ORF2 (NphB) recombinant mutant V49L, K119D, G205M
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 53 - protein, 307 aa, Artificial Sequence
  ORF2 (NphB) recombinant mutant K119A, S214G, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKATYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 54 - protein, 307 aa, Artificial Sequence
  ORF2 (NphB) recombinant mutant Q38G, Y216A, A232S
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 55 - protein, 307 aa, Artificial Sequence
  ORF2 (NphB) recombinant mutant Q161A, V271E, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVWRGLLKAFDSLED

SEQ ID NO: 56 - protein, 307 aa, Artificial Sequence
  ORF2 (NphB) recombinant mutant V49S, Y216A, V294N
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 57 - protein, 307 aa, Artificial Sequence
  ORF2 (NphB) recombinant mutant F123A, M162F, S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQFTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 58 - protein, 307 aa, Artificial Sequence
  ORF2 (NphB) recombinant mutant C25V, A232S, V271E
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLEYGLTLSPKEEYYKLGAYYHITDVQRGLLKAFDSLED

SEQ ID NO: 59 - protein, 307 aa, Artificial Sequence
  ORF2 (NphB) recombinant mutant K118Q, L174V, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 60 - protein, 307 aa, Artificial Sequence
  ORF2 (NphB) recombinant mutant V49S, S214G, V294A
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 61 - protein, 307 aa, Artificial Sequence
  ORF2 (NphB) recombinant mutant E112D, K119A, N173D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGDVTGGFKATYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 62 - protein, 307 aa, Artificial Sequence
  ORF2 (NphB) recombinant mutant F123W, Q161W, D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 63 - protein, 307 aa, Artificial Sequence
  ORF2 (NphB) recombinant mutant A53T, N173D, S214R
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 64 - protein, 307 aa, Artificial Sequence
  ORF2 (NphB) recombinant mutant F123W, M162F, C209G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQFTSMDYKKRQVNLYFSELSAQTLEAESVLALVRELGLHVPNELGLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 65 - protein, 307 aa, Artificial Sequence
  ORF2 (NphB) recombinant mutant M106E, M162A, Y216A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 66 - protein, 307 aa, Artificial Sequence
  ORF2 (NphB) recombinant mutant V49A, Q161S, V294A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 67 - protein, 307 aa, Artificial Sequence
  ORF2 (NphB) recombinant mutant C25V, F213M, Y216A
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSMSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 68 - protein, 307 aa, Artificial Sequence
  ORF2 (NphB) recombinant mutant A108G, K119D, L298A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 69 - protein, 307 aa, Artificial Sequence
  ORF2 (NphB) recombinant mutant K118N, C209G, R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFGKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 70 - protein, 307 aa, Artificial Sequence
  ORF2 (NphB) recombinant mutant A53T, M106E, Q161S
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 71 - protein, 307 aa, Artificial Sequence
  ORF2 (NphB) recombinant mutant Q38G, D166E, Q295A
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 72 - protein, 307 aa, Artificial Sequence
  ORF2 (NphB) recombinant mutant M106E, G205L, C209G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFGKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 73 - protein, 307 aa, Artificial Sequence
  ORF2 (NphB) recombinant mutant E112G, G205M, L298W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGWLKAFDSLED

SEQ ID NO: 74 - protein, 307 aa, Artificial Sequence
  ORF2 (NphB) recombinant mutant V49S, K118Q, S177E
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 75 - protein, 307 aa, Artificial Sequence
  ORF2 (NphB) recombinant mutant M106E, Y121W, D166E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTWAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 76 - protein, 307 aa, Artificial Sequence
  ORF2 (NphB) recombinant mutant A53Q, L274V, Q295A
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVARGLLKAFDSLED

SEQ ID NO: 77 - protein, 307 aa, Artificial Sequence
  ORF2 (NphB) recombinant mutant V49A, F123A, Y288H
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 78 - protein, 307 aa, Artificial Sequence
  ORF2 (NphB) recombinant mutant C25V, F123H, Q295N
MSEAADVERVYAAMEEAAGLLGVAVARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 79 - protein, 307 aa, Artificial Sequence
  ORF2 (NphB) recombinant mutant K119D, Q161W, L298Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGQLKAFDSLED

SEQ ID NO: 80 - protein, 307 aa, Artificial Sequence
  ORF2 (NphB) recombinant mutant V49A, Y121W, C230S
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 81 - protein, 307 aa, Artificial Sequence
  ORF2 (NphB) recombinant mutant M162A, N173D, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVDLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 82 - protein, 307 aa, Artificial Sequence
  ORF2 (NphB) recombinant mutant V49L, D166E, L274V
MSEAADVERVYAAMEEAAGLLGVACARDKIYPLLSTFQDTLVEGGSVVLFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 83 - protein, 307 aa, Artificial Sequence
  ORF2 (NphB) recombinant mutant V49S, K119D, F213M
MSEAADVERVYAAMEEAAGLLGVACARDKIYPLLSTFQDTLVEGGSVVSFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSMSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 84 - protein, 307 aa, Artificial Sequence
  ORF2 (NphB) recombinant mutant E112D, L219F, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 85 - protein, 307 aa, Artificial Sequence
  ORF2 (NphB) recombinant mutant F123H, L174V, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNVYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 86 - protein, 307 aa, Artificial Sequence
  ORF2 (NphB) recombinant mutant E112G, F123H, S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGGVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 87 - protein, 307 aa, Artificial Sequence
  ORF2 (NphB) recombinant mutant F123A, S177W, G205L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFWELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 88 - protein, 307 aa, Artificial Sequence
  ORF2 (NphB) recombinant mutant S177W, Y288H, V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDNQRGLLKAFDSLED

SEQ ID NO: 89 - protein, 307 aa, Artificial Sequence
  ORF2 (NphB) recombinant mutant A108G, Q161S, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVSMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 90 - protein, 307 aa, Artificial Sequence
  ORF2 (NphB) recombinant mutant Y121W, S177Y, G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTWAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 91 - protein, 307 aa, Artificial Sequence
  ORF2 (NphB) recombinant mutant A17T, F123W, L298A
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGALKAFDSLED

SEQ ID NO: 92 - protein, 307 aa, Artificial Sequence
  ORF2 (NphB) recombinant mutant N173D, F213M, V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSMSVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 93 - protein, 307 aa, Artificial Sequence
  ORF2 (NphB) recombinant mutant A53T, E112D, G205M
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGDVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 94 - protein, 307 aa, Artificial Sequence
  ORF2 (NphB) recombinant mutant Q38G, L174V, S214R
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 95 - protein, 307 aa, Artificial Sequence
  ORF2 (NphB) recombinant mutant A17T, V49A, C230N
MSEAADVERVYAAMEETAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLNFAVISNDPTLVPSSDEGDIEKFHNYATKAPYAYVGEKRTLVYGLTLSPKEEYYKLGAYYHITDVQRGLLKAFDSLED

SEQ ID NO: 96 - protein, 307 aa, Artificial Sequence
  ORF2 (NphB) recombinant mutant A17T, Q161W, A232S
MSEAADVERVYAAMEETAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 97 - protein, 307 aa, Artificial Sequence
  ORF2 (NphB) recombinant mutant Q161W, R228Q, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVWRGLLKAFDSLED

SEQ ID NO: 98 - protein, 307 aa, Artificial Sequence
  ORF2 (NphB) recombinant mutant Y288A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAAYHITDVQRGLLKAFDSLED

SEQ ID NO: 99 - protein, 307 aa, Artificial Sequence
  ORF2 (NphB) recombinant mutant Y288C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGACYHITDVQRGLLKAFDSLED

SEQ ID NO: 100 - protein, 307 aa, Artificial Sequence
  ORF2 (NphB) recombinant mutant Y288D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGADYHITDVQRGLLKAFDSLED

SEQ ID NO: 101 - protein, 307 aa, Artificial Sequence
  ORF2 (NphB) recombinant mutant Y288E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAEYHITDVQRGLLKAFDSLED

SEQ ID NO: 102 - protein, 307 aa, Artificial Sequence
  ORF2 (NphB) recombinant mutant Y288F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAFYHITDVQRGLLKAFDSLED

SEQ ID NO: 103 - protein, 307 aa, Artificial Sequence
  ORF2 (NphB) recombinant mutant Y288G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAGYHITDVQRGLLKAFDSLED

SEQ ID NO: 104 - protein, 307 aa, Artificial Sequence
  ORF2 (NphB) recombinant mutant Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 105 - protein, 307 aa, Artificial Sequence
  ORF2 (NphB) recombinant mutant Y288I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAIYHITDVQRGLLKAFDSLED

SEQ ID NO: 106 - protein, 307 aa, Artificial Sequence
  ORF2 (NphB) recombinant mutant Y288K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAKYHITDVQRGLLKAFDSLED

SEQ ID NO: 107 - protein, 307 aa, Artificial Sequence
  ORF2 (NphB) recombinant mutant Y288L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGALYHITDVQRGLLKAFDSLED

SEQ ID NO: 108 - protein, 307 aa, Artificial Sequence
  ORF2 (NphB) recombinant mutant Y288M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAMYHITDVQRGLLKAFDSLED

SEQ ID NO: 109 - protein, 307 aa, Artificial Sequence
  ORF2 (NphB) recombinant mutant Y288N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGANYHITDVQRGLLKAFDSLED

SEQ ID NO: 110 - protein, 307 aa, Artificial Sequence
  ORF2 (NphB) recombinant mutant Y288P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAPYHITDVQRGLLKAFDSLED

SEQ ID NO: 111 - protein, 307 aa, Artificial Sequence
  ORF2 (NphB) recombinant mutant Y288Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAQYHITDVQRGLLKAFDSLED

SEQ ID NO: 112 - protein, 307 aa, Artificial Sequence
  ORF2 (NphB) recombinant mutant Y288R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGARYHITDVQRGLLKAFDSLED

SEQ ID NO: 113 - protein, 307 aa, Artificial Sequence
  ORF2 (NphB) recombinant mutant Y288S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGASYHITDVQRGLLKAFDSLED

SEQ ID NO: 114 - protein, 307 aa, Artificial Sequence
  ORF2 (NphB) recombinant mutant Y288T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGATYHITDVQRGLLKAFDSLED

SEQ ID NO: 115 - protein, 307 aa, Artificial Sequence
  ORF2 (NphB) recombinant mutant Y288V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAVYHITDVQRGLLKAFDSLED

SEQ ID NO: 116 - protein, 307 aa, Artificial Sequence
  ORF2 (NphB) recombinant mutant Y288W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAWYHITDVQRGLLKAFDSLED

SEQ ID NO: 117 - protein, 307 aa, Artificial Sequence [sequence omitted]

SEQ ID NO: 118 - protein, 307 aa, Artificial Sequence
  ORF2 (NphB) recombinant mutant Q161A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVAMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 119 - protein, 307 aa, Artificial Sequence
  ORF2 (NphB) recombinant mutant Q161C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVCMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 120 - protein, 307 aa, Artificial Sequence
  ORF2 (NphB) recombinant mutant Q161D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVDMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 121 - protein, 307 aa, Artificial Sequence
  ORF2 (NphB) recombinant mutant Q161E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVEMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 122 - protein, 307 aa, Artificial Sequence
  ORF2 (NphB) recombinant mutant Q161F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVFMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 123 - protein, 307 aa, Artificial Sequence
  ORF2 (NphB) recombinant mutant Q161G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVGMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 124 - protein, 307 aa, Artificial Sequence
  ORF2 (NphB) recombinant mutant Q161H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVHMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 125 - protein, 307 aa, Artificial Sequence
  ORF2 (NphB) recombinant mutant Q161I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVIMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 126 - protein, 307 aa, Artificial Sequence
  ORF2 (NphB) recombinant mutant Q161K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVKMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 127 - protein, 307 aa, Artificial Sequence
  ORF2 (NphB) recombinant mutant Q161L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVLMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 128 - protein, 307 aa, Artificial Sequence
  ORF2 (NphB) recombinant mutant Q161M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVMMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 129 - protein, 307 aa, Artificial Sequence
  ORF2 (NphB) recombinant mutant Q161N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVNMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 130 - protein, 307 aa, Artificial Sequence
  ORF2 (NphB) recombinant mutant Q161P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVPMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 131 - protein, 307 aa, Artificial Sequence [sequence omitted]

SEQ ID NO: 132 - protein, 307 aa, Artificial Sequence
  ORF2 (NphB) recombinant mutant Q161R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVRMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 133 - protein, 307 aa, Artificial Sequence
  ORF2 (NphB) recombinant mutant Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 134 - protein, 307 aa, Artificial Sequence
  ORF2 (NphB) recombinant mutant Q161T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVTMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 135 - protein, 307 aa, Artificial Sequence
  ORF2 (NphB) recombinant mutant Q161V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVVMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 136 - protein, 307 aa, Artificial Sequence
  ORF2 (NphB) recombinant mutant Q161W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVWMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 137 - protein, 307 aa, Artificial Sequence
  ORF2 (NphB) recombinant mutant Q161Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVYMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 138 - protein, 307 aa, Artificial Sequence
  ORF2 (NphB) recombinant mutant Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 139 - protein, 307 aa, Artificial Sequence
  ORF2 (NphB) recombinant mutant Q295C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVCRGLLKAFDSLED

SEQ ID NO: 140 - protein, 307 aa, Artificial Sequence
  ORF2 (NphB) recombinant mutant Q295D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVDRGLLKAFDSLED

SEQ ID NO: 141 - protein, 307 aa, Artificial Sequence
  ORF2 (NphB) recombinant mutant Q295E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVERGLLKAFDSLED

SEQ ID NO: 142 - protein, 307 aa, Artificial Sequence
  ORF2 (NphB) recombinant mutant Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 143 - protein, 307 aa, Artificial Sequence
  ORF2 (NphB) recombinant mutant Q295G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVGRGLLKAFDSLED

SEQ ID NO: 144 - protein, 307 aa, Artificial Sequence
  ORF2 (NphB) recombinant mutant Q295H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVHRGLLKAFDSLED

SEQ ID NO: 145 - protein, 307 aa, Artificial Sequence
  ORF2 (NphB) recombinant mutant Q295I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVIRGLLKAFDSLED

SEQ ID NO: 146 - protein, 307 aa, Artificial Sequence
  ORF2 (NphB) recombinant mutant Q295K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVKRGLLKAFDSLED

SEQ ID NO: 147 - protein, 307 aa, Artificial Sequence
  ORF2 (NphB) recombinant mutant Q295L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 148 - protein, 307 aa, Artificial Sequence
  ORF2 (NphB) recombinant mutant Q295M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVMRGLLKAFDSLED

SEQ ID NO: 149 - protein, 307 aa, Artificial Sequence
  ORF2 (NphB) recombinant mutant Q295N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVNRGLLKAFDSLED

SEQ ID NO: 150 - protein, 307 aa, Artificial Sequence
  ORF2 (NphB) recombinant mutant Q295P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVPRGLLKAFDSLED

SEQ ID NO: 151 - protein, 307 aa, Artificial Sequence [sequence omitted]

SEQ ID NO: 152 - protein, 307 aa, Artificial Sequence
  ORF2 (NphB) recombinant mutant Q295R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVRRGLLKAFDSLED

SEQ ID NO: 153 - protein, 307 aa, Artificial Sequence
  ORF2 (NphB) recombinant mutant Q295S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVSRGLLKAFDSLED

SEQ ID NO: 154 - protein, 307 aa, Artificial Sequence
  ORF2 (NphB) recombinant mutant Q295T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVTRGLLKAFDSLED

SEQ ID NO: 155 - protein, 307 aa, Artificial Sequence
  ORF2 (NphB) recombinant mutant Q295V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVVRGLLKAFDSLED

SEQ ID NO: 156 - protein, 307 aa, Artificial Sequence
  ORF2 (NphB) recombinant mutant Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 157 - protein, 307 aa, Artificial Sequence
  ORF2 (NphB) recombinant mutant Q295Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVYRGLLKAFDSLED

SEQ ID NO: 158 - protein, 307 aa, Artificial Sequence
  ORF2 (NphB) recombinant mutant S214A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFAVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 159 - protein, 307 aa, Artificial Sequence
  ORF2 (NphB) recombinant mutant S214C
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFCVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 160 - protein, 307 aa, Artificial Sequence
  ORF2 (NphB) recombinant mutant S214D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFDVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 161 - protein, 307 aa, Artificial Sequence
  ORF2 (NphB) recombinant mutant S214E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFEVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 162 - protein, 307 aa, Artificial Sequence
  ORF2 (NphB) recombinant mutant S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 163 - protein, 307 aa, Artificial Sequence
  ORF2 (NphB) recombinant mutant S214G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFGVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 164 - protein, 307 aa, Artificial Sequence
  ORF2 (NphB) recombinant mutant S214H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFHVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 165 - protein, 307 aa, Artificial Sequence
  ORF2 (NphB) recombinant mutant S214I
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFIVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 166 - protein, 307 aa, Artificial Sequence
  ORF2 (NphB) recombinant mutant S214K
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFKVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 167 - protein, 307 aa, Artificial Sequence
  ORF2 (NphB) recombinant mutant S214L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFLVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 168 - protein, 307 aa, Artificial Sequence
  ORF2 (NphB) recombinant mutant S214M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFMVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 169 - protein, 307 aa, Artificial Sequence
  ORF2 (NphB) recombinant mutant S214N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFNVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 170 - protein, 307 aa, Artificial Sequence
  ORF2 (NphB) recombinant mutant S214P
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFPVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 171 - protein, 307 aa, Artificial Sequence
  ORF2 (NphB) recombinant mutant S214Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFQVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 172 - protein, 307 aa, Artificial Sequence
  ORF2 (NphB) recombinant mutant S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 173 - protein, 307 aa, Artificial Sequence [sequence omitted]

SEQ ID NO: 174 - protein, 307 aa, Artificial Sequence
  ORF2 (NphB) recombinant mutant S214T
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFTVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 175 - protein, 307 aa, Artificial Sequence
  ORF2 (NphB) recombinant mutant S214V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFVVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 176 - protein, 307 aa, Artificial Sequence
  ORF2 (NphB) recombinant mutant S214W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFWVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 177 - protein, 307 aa, Artificial Sequence
  ORF2 (NphB) recombinant mutant S214Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFYVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 178 - protein, 307 aa, Artificial Sequence [sequence omitted]

SEQ ID NO: 179 - protein, 307 aa, Artificial Sequence
  ORF2 (NphB) recombinant mutant A53C
MSEAADVERVYAAMEEAAGLLGVACARDKIYPLLSTFQDTLVEGGSVVVFSMCSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 180 - protein, 307 aa, Artificial Sequence
  ORF2 (NphB) recombinant mutant A53D
MSEAADVERVYAAMEEAAGLLGVACARDKIYPLLSTFQDTLVEGGSVVVFSMDSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 181 - protein, 307 aa, Artificial Sequence
  ORF2 (NphB) recombinant mutant A53E
MSEAADVERVYAAMEEAAGLLGVACARDKIYPLLSTFQDTLVEGGSVVVFSMESGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 182 - protein, 307 aa, Artificial Sequence
  ORF2 (NphB) recombinant mutant A53F
MSEAADVERVYAAMEEAAGLLGVACARDKIYPLLSTFQDTLVEGGSVVVFSMFSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 183 - protein, 307 aa, Artificial Sequence
  ORF2 (NphB) recombinant mutant A53G
MSEAADVERVYAAMEEAAGLLGVACARDKIYPLLSTFQDTLVEGGSVVVFSMGSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 184 - protein, 307 aa, Artificial Sequence
  ORF2 (NphB) recombinant mutant A53H
MSEAADVERVYAAMEEAAGLLGVACARDKIYPLLSTFQDTLVEGGSVVVFSMHSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 185 - protein, 307 aa, Artificial Sequence
  ORF2 (NphB) recombinant mutant A53I
MSEAADVERVYAAMEEAAGLLGVACARDKIYPLLSTFQDTLVEGGSVVVFSMISGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 186 - protein, 307 aa, Artificial Sequence
  ORF2 (NphB) recombinant mutant A53K
MSEAADVERVYAAMEEAAGLLGVACARDKIYPLLSTFQDTLVEGGSVVVFSMKSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 187 - protein, 307 aa, Artificial Sequence
  ORF2 (NphB) recombinant mutant A53L
MSEAADVERVYAAMEEAAGLLGVACARDKIYPLLSTFQDTLVEGGSVVVFSMLSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 188 - protein, 307 aa, Artificial Sequence
  ORF2 (NphB) recombinant mutant A53M
MSEAADVERVYAAMEEAAGLLGVACARDKIYPLLSTFQDTLVEGGSVVVFSMMSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 189 - protein, 307 aa, Artificial Sequence
  ORF2 (NphB) recombinant mutant A53N
MSEAADVERVYAAMEEAAGLLGVACARDKIYPLLSTFQDTLVEGGSVVVFSMNSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 190 - protein, 307 aa, Artificial Sequence
  ORF2 (NphB) recombinant mutant A53P
MSEAADVERVYAAMEEAAGLLGVACARDKIYPLLSTFQDTLVEGGSVVVFSMPSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 191 - protein, 307 aa, Artificial Sequence
  ORF2 (NphB) recombinant mutant A53Q
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 192 - protein, 307 aa, Artificial Sequence
  ORF2 (NphB) recombinant mutant A53R
MSEAADVERVYAAMEEAAGLLGVACARDKIYPLLSTFQDTLVEGGSVVVFSMRSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 193 - protein, 307 aa, Artificial Sequence
  ORF2 (NphB) recombinant mutant A53S
MSEAADVERVYAAMEEAAGLLGVACARDKIYPLLSTFQDTLVEGGSVVVFSMSSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 194 - protein, 307 aa, Artificial Sequence
  ORF2 (NphB) recombinant mutant A53T
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 195 - protein, 307 aa, Artificial Sequence
  ORF2 (NphB) recombinant mutant A53V
MSEAADVERVYAAMEEAAGLLGVACARDKIYPLLSTFQDTLVEGGSVVVFSMVSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 196 - protein, 307 aa, Artificial Sequence
  ORF2 (NphB) recombinant mutant A53W
MSEAADVERVYAAMEEAAGLLGVACARDKIYPLLSTFQDTLVEGGSVVVFSMWSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 197 - protein, 307 aa, Artificial Sequence
  ORF2 (NphB) recombinant mutant A53Y
MSEAADVERVYAAMEEAAGLLGVACARDKIYPLLSTFQDTLVEGGSVVVFSMYSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 198 - protein, 307 aa, Artificial Sequence
  ORF2 (NphB) recombinant mutant V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 199 - protein, 307 aa, Artificial Sequence
  ORF2 (NphB) recombinant mutant L219F, V294N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 200 - protein, 307 aa, Artificial Sequence
  ORF2 (NphB) recombinant mutant L219F, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 201 - protein, 307 aa, Artificial Sequence
  ORF2 (NphB) recombinant mutant V294N, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 202 - protein, 307 aa, Artificial Sequence
  ORF2 (NphB) recombinant mutant L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 203 - protein, 307 aa, Artificial Sequence
  ORF2 (NphB) recombinant mutant V49A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 204 - protein, 307 aa, Artificial Sequence
  ORF2 (NphB) recombinant mutant V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 205 - protein, 307 aa, Artificial Sequence
  ORF2 (NphB) recombinant mutant V49A, V294A
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 206 - protein, 307 aa, Artificial Sequence
  ORF2 (NphB) recombinant mutant Q161S, V294A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 207 - protein, 307 aa, Artificial Sequence
  ORF2 (NphB) recombinant mutant V49A, Q161S
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 208 - protein, 307 aa, Artificial Sequence
  ORF2 (NphB) recombinant mutant S177Y
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 209 - protein, 307 aa, Artificial Sequence; identical to SEQ ID NO: 104
  ORF2 (NphB) recombinant mutant Y288H

SEQ ID NO: 210 - protein, 307 aa, Artificial Sequence
  ORF2 (NphB) recombinant mutant A53Q, Y288H
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 211 - protein, 307 aa, Artificial Sequence
  ORF2 (NphB) recombinant mutant S177Y, Y288H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAHYHITDVQRGLLKAFDSLED

SEQ ID NO: 212 - protein, 307 aa, Artificial Sequence
  ORF2 (NphB) recombinant mutant A53Q, S177Y
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFYELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 213 - protein, 307 aa, Artificial Sequence
  ORF2 (NphB) recombinant mutant D166E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 214 - protein, 307 aa, Artificial Sequence
  ORF2 (NphB) recombinant mutant A53T, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 215 - protein, 307 aa, Artificial Sequence
  ORF2 (NphB) recombinant mutant D166E, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 216 - protein, 307 aa, Artificial Sequence
  ORF2 (NphB) recombinant mutant A53T D166E
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 217 - protein, 307 aa, Artificial Sequence
  ORF2 (NphB) recombinant mutant F123H
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 218 - protein, 307 aa, Artificial Sequence
  ORF2 (NphB) recombinant mutant L174V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 219 - protein, 307 aa, Artificial Sequence
  ORF2 (NphB) recombinant mutant S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 220 - protein, 307 aa, Artificial Sequence
  ORF2 (NphB) recombinant mutant F123H, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNLYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 221 - protein, 307 aa, Artificial Sequence
  ORF2 (NphB) recombinant mutant L174V, S177E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNVYFEELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 222 - protein, 307 aa, Artificial Sequence
  ORF2 (NphB) recombinant mutant F123H, L174V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAHFPTDNMPGVAELSAIPSMPPAVAENAELFARYGLDKVQMTSMDYKKRQVNVYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 223 - protein, 307 aa, Artificial Sequence
  ORF2 (NphB) recombinant mutant M106E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 224 - protein, 307 aa, Artificial Sequence
  ORF2 (NphB) recombinant mutant A53T, Q161S
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 225 - protein, 307 aa, Artificial Sequence
  ORF2 (NphB) recombinant mutant M106E, Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 226 - protein, 307 aa, Artificial Sequence
  ORF2 (NphB) recombinant mutant A53T, M106E
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSEFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 227 - protein, 307 aa, Artificial Sequence
  ORF2 (NphB) recombinant mutant Q38G
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 228 - protein, 307 aa, Artificial Sequence; identical to SEQ ID NO: 213
  ORF2 (NphB) recombinant mutant D166E

SEQ ID NO: 229 - protein, 307 aa, Artificial Sequence; identical to SEQ ID NO: 138
  ORF2 (NphB) recombinant mutant Q295A

SEQ ID NO: 230 - protein, 307 aa, Artificial Sequence
  ORF2 (NphB) recombinant mutant Q38G, Q295A
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 231 - protein, 307 aa, Artificial Sequence
  ORF2 (NphB) recombinant mutant D166E, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 232 - protein, 307 aa, Artificial Sequence
  ORF2 (NphB) recombinant mutant Q38G, D166E
MSEAADVERVYAAMEEAAGLLGVACARDKIYPLLSTFGDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMEYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 233 - protein, 307 aa, Artificial Sequence
  ORF2 (NphB) recombinant mutant K118N
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 234 - protein, 307 aa, Artificial Sequence; identical to SEQ ID NO: 162
  ORF2 (NphB) recombinant mutant S214F

SEQ ID NO: 235 - protein, 307 aa, Artificial Sequence
  ORF2 (NphB) recombinant mutant A53T, S214F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 236 - protein, 307 aa, Artificial Sequence
  ORF2 (NphB) recombinant mutant K118N, S214F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFFVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 237 - protein, 307 aa, Artificial Sequence
  ORF2 (NphB) recombinant mutant A53T, K118N
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFNKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 238 - protein, 307 aa, Artificial Sequence
  ORF2 (NphB) recombinant mutant S177W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 239 - protein, 307 aa, Artificial Sequence; identical to SEQ ID NO: 202
  ORF2 (NphB) recombinant mutant L219F

SEQ ID NO: 240 - protein, 307 aa, Artificial Sequence
  ORF2 (NphB) recombinant mutant S177W, L219F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 241 - protein, 307 aa, Artificial Sequence
  ORF2 (NphB) recombinant mutant A53Q, S177W
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 242 - protein, 307 aa, Artificial Sequence
  ORF2 (NphB) recombinant mutant A53Q, L219F
MSEAADVERVYAAMEEAAGLLGVACARDKIYPLLSTFQDTLVEGGSVVVFSMQSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTFNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 243 - protein, 307 aa, Artificial Sequence
  ORF2 (NphB) recombinant mutant A108G
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 244 - protein, 307 aa, Artificial Sequence
  ORF2 (NphB) recombinant mutant G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 245 - protein, 307 aa, Artificial Sequence
  ORF2 (NphB) recombinant mutant A108G, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVQMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 246 - protein, 307 aa, Artificial Sequence
  ORF2 (NphB) recombinant mutant Q161S, G205M
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELMLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 247 - protein, 307 aa, Artificial Sequence
  ORF2 (NphB) recombinant mutant A108G, Q161S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFGIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 248 - protein, 307 aa, Artificial Sequence
  ORF2 (NphB) recombinant mutant K118Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFQKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 249 - protein, 307 aa, Artificial Sequence
  ORF2 (NphB) recombinant mutant M162A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQATSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 250 - protein, 307 aa, Artificial Sequence
  ORF2 (NphB) recombinant mutant Y283L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYLKLGAYYHITDVQRGLLKAFDSLED

SEQ ID NO: 251 - protein, 307 aa, Artificial Sequence
  ORF2 (NphB) recombinant mutant V271E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLEYGLTLSPKEEYYKLGAYYHITDVQRGLLKAFDSLED

SEQ ID NO: 252 - protein, 307 aa, Artificial Sequence
  ORF2 (NphB) recombinant mutant K119D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKDTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 253 - protein, 307 aa, Artificial Sequence
  ORF2 (NphB) recombinant mutant L274V
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGVTLSPKEEYYKLGAYYHITDVQRGLLKAFDSLED

SEQ ID NO: 254 - protein, 307 aa, Artificial Sequence
  ORF2 (NphB) recombinant mutant A232S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFSVISNDPTLVPSSDEGDIEKFHNYATKAPYAYVGEKRTLVYGLTLSPKEEYYKLGAYYHITDVQRGLLKAFDSLED

SEQ ID NO: 255 - protein, 307 aa, Artificial Sequence; identical to SEQ ID NO: 118
  ORF2 (NphB) recombinant mutant Q161A

SEQ ID NO: 256 - protein, 307 aa, Artificial Sequence
  ORF2 (NphB) recombinant mutant G205L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELLLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 257 - protein, 307 aa, Artificial Sequence; identical to SEQ ID NO: 163
  ORF2 (NphB) recombinant mutant S214G

SEQ ID NO: 258 - protein, 307 aa, Artificial Sequence
  ORF2 (NphB) recombinant mutant Y216A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVAPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 259 - protein, 307 aa, Artificial Sequence
  ORF2 (NphB) recombinant mutant N173D
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVDLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 260 - protein, 307 aa, Artificial Sequence
  ORF2 (NphB) recombinant mutant F123W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAWFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 261 - protein, 307 aa, Artificial Sequence; identical to SEQ ID NO: 233
  ORF2 (NphB) recombinant mutant K118N

SEQ ID NO: 262 - protein, 307 aa, Artificial Sequence
  ORF2 (NphB) recombinant mutant R228Q
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDQLCFAVISNDPTLVPSSDEGDIEKFHNYATKAPYAYVGEKRTLVYGLTLSPKEEYYKLGAYYHITDVQRGLLKAFDSLED

SEQ ID NO: 263 - protein, 307 aa, Artificial Sequence; identical to SEQ ID NO: 136
  ORF2 (NphB) recombinant mutant Q161W

SEQ ID NO: 264 - protein, 307 aa, Artificial Sequence
  ORF2 (NphB) recombinant mutant V294F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDFQRGLLKAFDSLED

SEQ ID NO: 265 - protein, 307 aa, Artificial Sequence; identical to SEQ ID NO: 172
  ORF2 (NphB) recombinant mutant S214R

SEQ ID NO: 266 - protein, 307 aa, Artificial Sequence
  ORF2 (NphB) recombinant mutant G286E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLEAYYHITDVQRGLLKAFDSLED

SEQ ID NO: 267 - protein, 307 aa, Artificial Sequence
  ORF2 (NphB) recombinant mutant R228E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDELCFAVISNDPTLVPSSDEGDIEKFHNYATKAPYAYVGEKRTLVYGLTLSPKEEYYKLGAYYHITDVQRGLLKAFDSLED

SEQ ID NO: 268 - protein, 307 aa, Artificial Sequence
  ORF2 (NphB) recombinant mutant C230S
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLSFAVISNDPTLVPSSDEGDIEKFHNYATKAPYAYVGEKRTLVYGLTLSPKEEYYKLGAYYHITDVQRGLLKAFDSLED

SEQ ID NO: 269 - protein, 307 aa, Artificial Sequence
  ORF2 (NphB) recombinant mutant D227E
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIERLCFAVISNDPTLVPSSDEGDIEKFHNYATKAPYAYVGEKRTLVYGLTLSPKEEYYKLGAYYHITDVQRGLLKAFDSLED

SEQ ID NO: 270 - protein, 307 aa, Artificial Sequence
  ORF2 (NphB) recombinant mutant M162F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQFTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 271 - protein, 307 aa, Artificial Sequence
  ORF2 (NphB) recombinant mutant F123A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAAFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 272 - protein, 307 aa, Artificial Sequence
  ORF2 (NphB) recombinant mutant A53T, V294A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 273 - protein, 307 aa, Artificial Sequence
  ORF2 (NphB) recombinant mutant A53T, Q161S, V294A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAQRGLLKAFDSLED

SEQ ID NO: 274 - protein, 307 aa, Artificial Sequence
  ORF2 (NphB) recombinant mutant A53T, Q161S, V294N
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNQRGLLKAFDSLED

SEQ ID NO: 275 - protein, 307 aa, Artificial Sequence
  ORF2 (NphB) recombinant mutant A53T, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 276 - protein, 307 aa, Artificial Sequence
  ORF2 (NphB) recombinant mutant Q161S, V294A, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 277 - protein, 307 aa, Artificial Sequence
  ORF2 (NphB) recombinant mutant A53T, Q161S, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 278 - protein, 307 aa, Artificial Sequence
  ORF2 (NphB) recombinant mutant A53T, V294A, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 279 - protein, 307 aa, Artificial Sequence
  ORF2 (NphB) recombinant mutant A53T, Q161S, V294A, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAARGLLKAFDSLED

SEQ ID NO: 280 - protein, 307 aa, Artificial Sequence
  ORF2 (NphB) recombinant mutant A53T, Q161S, V294N, Q295A
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNARGLLKAFDSLED

SEQ ID NO: 281 - protein, 307 aa, Artificial Sequence; identical to SEQ ID NO: 214
  ORF2 (NphB) recombinant mutant A53T, Q295W

SEQ ID NO: 282 - protein, 307 aa, Artificial Sequence
  ORF2 (NphB) recombinant mutant Q161S, V294A, Q295W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 283 - protein, 307 aa, Artificial Sequence
  ORF2 (NphB) recombinant mutant A53T, Q161S, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVWRGLLKAFDSLED

SEQ ID NO: 284 - protein, 307 aa, Artificial Sequence
  ORF2 (NphB) recombinant mutant A53T, V294A, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 285 - protein, 307 aa, Artificial Sequence
  ORF2 (NphB) recombinant mutant A53T, Q161S, V294A, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDAWRGLLKAFDSLED

SEQ ID NO: 286 - protein, 307 aa, Artificial Sequence
  ORF2 (NphB) recombinant mutant A53T, Q161S, V294N, Q295W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDNWRGLLKAFDSLED

SEQ ID NO: 287 - protein, 307 aa, Artificial Sequence
  ORF2 (NphB) recombinant mutant S177W, Q295A
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVARGLLKAFDSLED

SEQ ID NO: 288 - protein, 307 aa, Artificial Sequence
  ORF2 (NphB) recombinant mutant S177W, S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 289 - protein, 307 aa, Artificial Sequence
  ORF2 (NphB) recombinant mutant Q161S, S177W
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 290 - protein, 307 aa, Artificial Sequence
  ORF2 (NphB) recombinant mutant A53T, S177W
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFWELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 291 - protein, 307 aa, Artificial Sequence
  ORF2 (NphB) recombinant mutant V49A, Q295L
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 292 - protein, 307 aa, Artificial Sequence
  ORF2 (NphB) recombinant mutant V49A, S214R
MSEAADVERVYAAMEEAAGLLGVACARDKIYPLLSTFQDTLVEGGSVVAFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 293 - protein, 307 aa, Artificial Sequence
  ORF2 (NphB) recombinant mutant A53T, Q295F
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 294 - protein, 307 aa, Artificial Sequence
  ORF2 (NphB) recombinant mutant A53T, S214R
MSEAADVERVYAAMEEAAGLLGVACARDKIYPLLSTFQDTLVEGGSVVVFSMTSGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 295 - protein, 307 aa, Artificial Sequence; identical to SEQ ID NO: 224
  ORF2 (NphB) recombinant mutant A53T, Q161S

SEQ ID NO: 296 - protein, 307 aa, Artificial Sequence
  ORF2 (NphB) recombinant mutant Q161S, Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 297 - protein, 307 aa, Artificial Sequence
  ORF2 (NphB) recombinant mutant Q161S, Q295L
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFSVYPTLNWETGKIDRLCFAVISNDPTLVPSSDEGDIEKFHNYATKAPYAYVGEKRTLVYGLTLSPKEEYYKLGAYYHITDVLRGLLKAFDSLED

SEQ ID NO: 298 - protein, 307 aa, Artificial Sequence
  ORF2 (NphB) recombinant mutant Q161S, S214R
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVSMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVQRGLLKAFDSLED

SEQ ID NO: 299 - protein, 307 aa, Artificial Sequence
  ORF2 (NphB) recombinant mutant S214R, Q295F
MSEAADVERVYAAMEEAAGLLGVACARDKIYPLLSTFQDTLVEGGSVVVFSMASGRHSTELDFSISVPTSHGDPYATVVEKGLFPATGHPVDDLLADTQKHLPVSMFAIDGEVTGGFKKTYAFFPTDNMPGVAELSAIPSMPPAVAENAELFARYGLDKVQMTSMDYKKRQVNLYFSELSAQTLEAESVLALVRELGLHVPNELGLKFCKRSFRVYPTLNWETGKIDRLCFAVISNDPTLVPSSDEGDIEKFHNYATKAPYAYVGEKRTLVYGLTLSPKEEYYKLGAYYHITDVFRGLLKAFDSLED

SEQ ID NO: 300 - protein, 307 aa, Artificial Sequence; identical to SEQ ID NO: 207
  ORF2 (NphB) recombinant mutant V49A, Q161S

SEQ ID NO: 301 - DNA, 927 bp, Unknown
  Streptomyces sp. strain CL190
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 302 - DNA, 927 bp, Artificial Sequence
  ORF2 (NphB) recombinant mutant A108G, Q295N, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggccagctgaaagcgtttgactctttggaagattaatga

SEQ ID NO: 303 - DNA, 927 bp, Artificial Sequence
  ORF2 (NphB) recombinant mutant K119A, Q161S, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 304 - DNA, 927 bp, Artificial Sequence
  ORF2 (NphB) recombinant mutant V49S, M162A, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 305 - DNA, 927 bp, Artificial Sequence
  ORF2 (NphB) recombinant mutant K118Q, Q161W, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 306 - DNA, 927 bp, Artificial Sequence
  ORF2 (NphB) recombinant mutant Q161A, S214G, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 307 - DNA, 927 bp, Artificial Sequence
  ORF2 (NphB) recombinant mutant F123W, S177W, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 308 - DNA, 927 bp, Artificial Sequence
  ORF2 (NphB) recombinant mutant K118N, N173D, Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 309 - DNA, 927 bp, Artificial Sequence
  ORF2 (NphB) recombinant mutant K119A, Q161A, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 310 - DNA, 927 bp, Artificial Sequence
  ORF2 (NphB) recombinant mutant Q38G, E112D, F123H
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 311 - DNA, 927 bp, Artificial Sequence
  ORF2 (NphB) recombinant mutant V49A, S177Y, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 312 - DNA, 927 bp, Artificial Sequence
  ORF2 (NphB) recombinant mutant K118N, K119A, V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacgcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 313 - DNA, 927 bp, Artificial Sequence
  ORF2 (NphB) recombinant mutant L174V, C230N, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 314 - DNA, 927 bp, Artificial Sequence
  ORF2 (NphB) recombinant mutant K119D, S177E, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 315 - DNA, 927 bp, Artificial Sequence
  ORF2 (NphB) recombinant mutant A53E, E112G, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 316 - DNA, 927 bp, Artificial Sequence
  ORF2 (NphB) recombinant mutant A53E, F213M, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 317 - DNA, 927 bp, Artificial Sequence
  ORF2 (NphB) recombinant mutant A53Q, S177W, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 318 - DNA, 927 bp, Artificial Sequence
  ORF2 (NphB) recombinant mutant F123A, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 319 - DNA, 927 bp, Artificial Sequence
  ORF2 (NphB) recombinant mutant C25V, Y121W, M162F
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 320 - DNA, 927 bp, Artificial Sequence
  ORF2 (NphB) recombinant mutant V49L, S214R, V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 321 - DNA, 927 bp, Artificial Sequence
  ORF2 (NphB) recombinant mutant D227E, C230N, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 322 - DNA, 927 bp, Artificial Sequence
  ORF2 (NphB) recombinant mutant G205L, Y216A, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgttgcgccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 323 - DNA, 927 bp, Artificial Sequence
  ORF2 (NphB) recombinant mutant Q161S, V294F, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggctggctgaaagcgtttgactctttggaagattaatga

SEQ ID NO: 324 - DNA, 927 bp, Artificial Sequence
  ORF2 (NphB) recombinant mutant L219F, Y283L, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggctggctgaaagcgtttgactctttggaagattaatga

SEQ ID NO: 325 - DNA, 927 bp, Artificial Sequence
  ORF2 (NphB) recombinant mutant A17T, F213M, S214R
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 326 - DNA, 927 bp, Artificial Sequence
  ORF2 (NphB) recombinant mutant L219F, V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcgcgtggcctgctgaaagcgtttgactctttggaagattaatga

SEQ ID NO: 327 - DNA, 927 bp, Artificial Sequence
  ORF2 (NphB) recombinant mutant A53E, A108G, K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 328 - DNA, 927 bp, Artificial Sequence
  ORF2 (NphB) recombinant mutant Q38G, E112G, M162F
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 329 - DNA, 927 bp, Artificial Sequence
  ORF2 (NphB) recombinant mutant A53T, D166E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 330 - DNA, 927 bp, Artificial Sequence
  ORF2 (NphB) recombinant mutant L174V, C230S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 331 - DNA, 927 bp, Artificial Sequence
  ORF2 (NphB) recombinant mutant M106E, G286E, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggctggctgaaagcgtttgactctttggaagattaatga

SEQ ID NO: 332 - DNA, 927 bp, Artificial Sequence
  ORF2 (NphB) recombinant mutant D227E, R228E, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaggagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 333 - DNA, 927 bp, Artificial Sequence
  ORF2 (NphB) recombinant mutant M162A, C209G, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 334 - DNA, 927 bp, Artificial Sequence
  ORF2 (NphB) recombinant mutant A17T, C25V, E112G
atgagcgaagcggcggacgtcgaacgtgtttatgcagcgatggaagaaaccgccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 335 - DNA, 927 bp, Artificial Sequence
  ORF2 (NphB) recombinant mutant A53Q, Y121W, A232S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 336 - DNA, 927 bp, Artificial Sequence
  ORF2 (NphB) recombinant mutant A53Q, S177Y, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 337 - DNA, 927 bp, Artificial Sequence
  ORF2 (NphB) recombinant mutant F123H, L274V, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcgcgctgaaagcgtttgactctttggaagattaatga

SEQ ID NO: 338 - DNA, 927 bp, Artificial Sequence
  ORF2 (NphB) recombinant mutant S177W, S214F, Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 339 - DNA, 927 bp, Artificial Sequence
  ORF2 (NphB) recombinant mutant A53E, G205M, L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 340 - DNA, 927 bp, Artificial Sequence
  ORF2 (NphB) recombinant mutant A53T, K118N, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 341 - DNA, 927 bp, Artificial Sequence
  ORF2 (NphB) recombinant mutant S177E, S214R, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 342 - DNA, 927 bp, Artificial Sequence
  ORF2 (NphB) recombinant mutant K118Q, S177Y, D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 343 - DNA, 927 bp, Artificial Sequence
  ORF2 (NphB) recombinant mutant D166E, S177Y, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 344 - DNA, 927 bp, Artificial Sequence
  ORF2 (NphB) recombinant mutant Q161A, M162F, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 345 - DNA, 927 bp, Artificial Sequence
  ORF2 (NphB) recombinant mutant A53E, Q161A, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 346 - DNA, 927 bp, Artificial Sequence
  ORF2 (NphB) recombinant mutant A108G, F123W, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 347 - DNA, 927 bp, Artificial Sequence
  ORF2 (NphB) recombinant mutant A53Q, G205L, Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 348 - DNA, 927 bp, Artificial Sequence
  ORF2 (NphB) recombinant mutant K118Q, F123A, R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 349 - DNA, 927 bp, Artificial Sequence
  ORF2 (NphB) recombinant mutant V49L, E112D, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 350 - DNA, 927 bp, Artificial Sequence
  ORF2 (NphB) recombinant mutant G205L, R228E, C230N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgacgagctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 351 - DNA, 927 bp, Artificial Sequence
  ORF2 (NphB) recombinant mutant M162A, D227E, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 352 - DNA, 927 bp, Artificial Sequence
  ORF2 (NphB) recombinant mutant V49L, K119D, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 353 - DNA, 927 bp, Artificial Sequence
  ORF2 (NphB) recombinant mutant K119A, S214G, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 354 - DNA, 927 bp, Artificial Sequence
  ORF2 (NphB) recombinant mutant Q38G, Y216A, A232S
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 355 - DNA, 927 bp, Artificial Sequence
  ORF2 (NphB) recombinant mutant Q161A, V271E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgtttggcgtggcctgctgaaagcgtttgactctttggaagattaatga

SEQ ID NO: 356 - DNA, 927 bp, Artificial Sequence
  ORF2 (NphB) recombinant mutant V49S, Y216A, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 357 - DNA, 927 bp, Artificial Sequence
  ORF2 (NphB) recombinant mutant F123A, M162F, S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 358 - DNA, 927 bp, Artificial Sequence
  ORF2 (NphB) recombinant mutant C25V, A232S, V271E
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 359 - DNA, 927 bp, Artificial Sequence
  ORF2 (NphB) recombinant mutant K118Q, L174V, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 360 - DNA, 927 bp, Artificial Sequence
  ORF2 (NphB) recombinant mutant V49S, S214G, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 361 - DNA, 927 bp, Artificial Sequence
  ORF2 (NphB) recombinant mutant E112D, K119A, N173D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaagcgacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 362 - DNA, 927 bp, Artificial Sequence
  ORF2 (NphB) recombinant mutant F123W, Q161W, D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 363 - DNA, 927 bp, Artificial Sequence
  ORF2 (NphB) recombinant mutant A53T, N173D, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 364 - DNA, 927 bp, Artificial Sequence
  ORF2 (NphB) recombinant mutant F123W, M162F, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 365 - DNA, 927 bp, Artificial Sequence
  ORF2 (NphB) recombinant mutant M106E, M162A, Y216A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 366 - DNA, 927 bp, Artificial Sequence
  ORF2 (NphB) recombinant mutant V49A, Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 367 - DNA, 927 bp, Artificial Sequence
  ORF2 (NphB) recombinant mutant C25V, F213M, Y216A
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 368 - DNA, 927 bp, Artificial Sequence
  ORF2 (NphB) recombinant mutant A108G, K119D, L298A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 369 - DNA, 927 bp, Artificial Sequence
  ORF2 (NphB) recombinant mutant K118N, C209G, R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattcggtaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 370 - DNA, 927 bp, Artificial Sequence
  ORF2 (NphB) recombinant mutant A53T, M106E, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 371 - DNA, 927 bp, Artificial Sequence
  ORF2 (NphB) recombinant mutant Q38G, D166E, Q295A
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 372 - DNA, 927 bp, Artificial Sequence
  ORF2 (NphB) recombinant mutant M106E, G205L, C209G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattcggtaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 373 - DNA, 927 bp, Artificial Sequence
  ORF2 (NphB) recombinant mutant E112G, G205M, L298W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggctggctgaaagcgtttgactctttggaagattaatga

SEQ ID NO: 374 - DNA, 927 bp, Artificial Sequence
  ORF2 (NphB) recombinant mutant V49S, K118Q, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 375 - DNA, 927 bp, Artificial Sequence
  ORF2 (NphB) recombinant mutant M106E, Y121W, D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 376 - DNA, 927 bp, Artificial Sequence
  ORF2 (NphB) recombinant mutant A53Q, L274V, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttgcgcgtggcctgctgaaagcgtttgactctttggaagattaatga

SEQ ID NO: 377 - DNA, 927 bp, Artificial Sequence
  ORF2 (NphB) recombinant mutant V49A, F123A, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 378 - DNA, 927 bp, Artificial Sequence
  ORF2 (NphB) recombinant mutant C25V, F123H, Q295N
atgagcgaagcggcggacgtcgaacgtgtttatgcagcgatggaagaagcagccggtttgctgggtgtggctgttgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaccgtggcctgctgaaagcgtttgactctttggaagattaatga

SEQ ID NO: 379 - DNA, 927 bp, Artificial Sequence
  ORF2 (NphB) recombinant mutant K119D, Q161W, L298Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggccagctgaaagcgtttgactctttggaagattaatga

SEQ ID NO: 380 - DNA, 927 bp, Artificial Sequence
  ORF2 (NphB) recombinant mutant V49A, Y121W, C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 381 - DNA, 927 bp, Artificial Sequence
  ORF2 (NphB) recombinant mutant M162A, N173D, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 382 - DNA, 927 bp, Artificial Sequence
  ORF2 (NphB) recombinant mutant V49L, D166E, L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcctgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 383 - DNA, 927 bp, Artificial Sequence
  ORF2 (NphB) recombinant mutant V49S, K119D, F213M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcagctttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 384 - DNA, 927 bp, Artificial Sequence
  ORF2 (NphB) recombinant mutant E112D, L219F, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 385 - DNA, 927 bp, Artificial Sequence
  ORF2 (NphB) recombinant mutant F123H, L174V, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 386 - DNA, 927 bp, Artificial Sequence
  ORF2 (NphB) recombinant mutant E112G, F123H, S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtggtgtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 387 - DNA, 927 bp, Artificial Sequence
  ORF2 (NphB) recombinant mutant F123A, S177W, G205L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 388 - DNA, 927 bp, Artificial Sequence
  ORF2 (NphB) recombinant mutant S177W, Y288H, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacaaccaacgtggcctgctgaaagcgtttgactctttggaagattaatga

SEQ ID NO: 389 - DNA, 927 bp, Artificial Sequence
  ORF2 (NphB) recombinant mutant A108G, Q161S, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 390 - DNA, 927 bp, Artificial Sequence
  ORF2 (NphB) recombinant mutant Y121W, S177Y, G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctgggctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 391 - DNA, 927 bp, Artificial Sequence
  ORF2 (NphB) recombinant mutant A17T, F123W, L298A
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcgcgctgaaagcgtttgactctttggaagattaatga

SEQ ID NO: 392 - DNA, 927 bp, Artificial Sequence
  ORF2 (NphB) recombinant mutant N173D, F213M, V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagcatgagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 393 - DNA, 927 bp, Artificial Sequence
  ORF2 (NphB) recombinant mutant A53T, E112D, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgacgtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 394 - DNA, 927 bp, Artificial Sequence
  ORF2 (NphB) recombinant mutant Q38G, L174V, S214R
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 395 - DNA, 927 bp, Artificial Sequence
  ORF2 (NphB) recombinant mutant A17T, V49A, C230N
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgaactttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 396 - DNA, 927 bp, Artificial Sequence
  ORF2 (NphB) recombinant mutant A17T, Q161W, A232S
atgagcgaagcggcggacgtcgaacgtgtttatgcagcgatggaagaaaccgccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 397 - DNA, 927 bp, Artificial Sequence
  ORF2 (NphB) recombinant mutant Q161W, R228Q, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 398 - DNA, 927 bp, Artificial Sequence
  ORF2 (NphB) recombinant mutant Y288A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggcataccacattaccgacgttcaacgtggcctgctgaaagcgtttgactctttggaagattaatga

SEQ ID NO: 399 - DNA, 927 bp, Artificial Sequence
  ORF2 (NphB) recombinant mutant Y288C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtgttaccacattaccgacgttcaacgtggcctgctgaaagcgtttgactctttggaagattaatga

SEQ ID NO: 400 - DNA, 927 bp, Artificial Sequence
  ORF2 (NphB) recombinant mutant Y288D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggattaccacattaccgacgttcaacgtggcctgctgaaagcgtttgactctttggaagattaatga

SEQ ID NO: 401 - DNA, 927 bp, Artificial Sequence
  ORF2 (NphB) recombinant mutant Y288E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggaataccacattaccgacgttcaacgtggcctgctgaaagcgtttgactctttggaagattaatga

SEQ ID NO: 402 - DNA, 927 bp, Artificial Sequence
  ORF2 (NphB) recombinant mutant Y288F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgttttaccacattaccgacgttcaacgtggcctgctgaaagcgtttgactctttggaagattaatga

SEQ ID NO: 403 - DNA, 927 bp, Artificial Sequence
  ORF2 (NphB) recombinant mutant Y288G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgggttaccacattaccgacgttcaacgtggcctgctgaaagcgtttgactctttggaagattaatga

SEQ ID NO: 404 - DNA, 927 bp, Artificial Sequence
  ORF2 (NphB) recombinant mutant Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcattaccacattaccgacgttcaacgtggcctgctgaaagcgtttgactctttggaagattaatga

SEQ ID NO: 405 - DNA, 927 bp, Artificial Sequence
  ORF2 (NphB) recombinant mutant Y288I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgatttaccacattaccgacgttcaacgtggcctgctgaaagcgtttgactctttggaagattaatga

SEQ ID NO: 406 - DNA, 927 bp, Artificial Sequence
  ORF2 (NphB) recombinant mutant Y288K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgaaataccacattaccgacgttcaacgtggcctgctgaaagcgtttgactctttggaagattaatga

SEQ ID NO: 407 - DNA, 927 bp, Artificial Sequence
  ORF2 (NphB) recombinant mutant Y288L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgctgtaccacattaccgacgttcaacgtggcctgctgaaagcgtttgactctttggaagattaatga

SEQ ID NO: 408 - DNA, 927 bp, Artificial Sequence
  ORF2 (NphB) recombinant mutant Y288M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgatgtaccacattaccgacgttcaacgtggcctgctgaaagcgtttgactctttggaagattaatga

SEQ ID NO: 409 - DNA, 927 bp, Artificial Sequence
  ORF2 (NphB) recombinant mutant Y288N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgaattaccacattaccgacgttcaacgtggcctgctgaaagcgtttgactctttggaagattaatga

SEQ ID NO: 410 - DNA, 927 bp, Artificial Sequence
  ORF2 (NphB) recombinant mutant Y288P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgccgtaccacattaccgacgttcaacgtggcctgctgaaagcgtttgactctttggaagattaatga

SEQ ID NO: 411 - DNA, 927 bp, Artificial Sequence
  ORF2 (NphB) recombinant mutant Y288Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcagtaccacattaccgacgttcaacgtggcctgctgaaagcgtttgactctttggaagattaatga

SEQ ID NO: 412 - DNA, 927 bp, Artificial Sequence
  ORF2 (NphB) recombinant mutant Y288R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcgttaccacattaccgacgttcaacgtggcctgctgaaagcgtttgactctttggaagattaatga

SEQ ID NO: 413 - DNA, 927 bp, Artificial Sequence
  ORF2 (NphB) recombinant mutant Y288S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgagctaccacattaccgacgttcaacgtggcctgctgaaagcgtttgactctttggaagattaatga

SEQ ID NO: 414 - DNA, 927 bp, Artificial Sequence
  ORF2 (NphB) recombinant mutant Y288T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgacctaccacattaccgacgttcaacgtggcctgctgaaagcgtttgactctttggaagattaatga

SEQ ID NO: 415 - DNA, 927 bp, Artificial Sequence
  ORF2 (NphB) recombinant mutant Y288V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcggtttaccacattaccgacgttcaacgtggcctgctgaaagcgtttgactctttggaagattaatga

SEQ ID NO: 416 - DNA, 927 bp, Artificial Sequence
  ORF2 (NphB) recombinant mutant Y288W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtggtaccacattaccgacgttcaacgtggcctgctgaaagcgtttgactctttggaagattaatga

SEQ ID NO: 417 - DNA, 927 bp, Artificial Sequence
  ORF2 (NphB) recombinant mutant Y288Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtattaccacattaccgacgttcaacgtggcctgctgaaagcgtttgactctttggaagattaatga

SEQ ID NO: 418 - DNA, 927 bp, Artificial Sequence
  ORF2 (NphB) recombinant mutant Q161A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 419 - DNA, 927 bp, Artificial Sequence
  ORF2 (NphB) recombinant mutant Q161C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtgtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 420 - DNA, 927 bp, Artificial Sequence
  ORF2 (NphB) recombinant mutant Q161D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 421 - DNA, 927 bp, Artificial Sequence
  ORF2 (NphB) recombinant mutant Q161E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggaaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 422 - DNA, 927 bp, Artificial Sequence
  ORF2 (NphB) recombinant mutant Q161F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtttatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 423 - DNA, 927 bp, Artificial Sequence
  ORF2 (NphB) recombinant mutant Q161G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgggtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 424 - DNA, 927 bp, Artificial Sequence
  ORF2 (NphB) recombinant mutant Q161H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 425 - DNA, 927 bp, Artificial Sequence
  ORF2 (NphB) recombinant mutant Q161I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgattatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 426 - DNA, 927 bp, Artificial Sequence
  ORF2 (NphB) recombinant mutant Q161K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaaaatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 427 - DNA, 927 bp, Artificial Sequence
  ORF2 (NphB) recombinant mutant Q161L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgctgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 428 - DNA, 927 bp, Artificial Sequence
  ORF2 (NphB) recombinant mutant Q161M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgatgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 429 - DNA, 927 bp, Artificial Sequence
  ORF2 (NphB) recombinant mutant Q161N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 430 - DNA, 927 bp, Artificial Sequence
  ORF2 (NphB) recombinant mutant Q161P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgccgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 431 - DNA, 927 bp, Artificial Sequence; identical to SEQ ID NO: 301
  ORF2 (NphB) recombinant mutant Q161Q

SEQ ID NO: 432 - DNA, 927 bp, Artificial Sequence
  ORF2 (NphB) recombinant mutant Q161R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcgtatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 433 - DNA, 927 bp, Artificial Sequence
  ORF2 (NphB) recombinant mutant Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 434 - DNA, 927 bp, Artificial Sequence
  ORF2 (NphB) recombinant mutant Q161T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgaccatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 435 - DNA, 927 bp, Artificial Sequence
  ORF2 (NphB) recombinant mutant Q161V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggttatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 436 - DNA, 927 bp, Artificial Sequence
  ORF2 (NphB) recombinant mutant Q161W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtggatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 437 - DNA, 927 bp, Artificial Sequence
  ORF2 (NphB) recombinant mutant Q161Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgtatatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 438 - DNA, 927 bp, Artificial Sequence
  ORF2 (NphB) recombinant mutant Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 439 - DNA, 927 bp, Artificial Sequence
  ORF2 (NphB) recombinant mutant Q295C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttgtcgtggcctgctgaaagcgtttgactctttggaagattaatga

SEQ ID NO: 440 - DNA, 927 bp, Artificial Sequence
  ORF2 (NphB) recombinant mutant Q295D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgatcgtggcctgctgaaagcgtttgactctttggaagattaatga

SEQ ID NO: 441 - DNA, 927 bp, Artificial Sequence
  ORF2 (NphB) recombinant mutant Q295E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgaacgtggcctgctgaaagcgtttgactctttggaagattaatga

SEQ ID NO: 442 - DNA, 927 bp, Artificial Sequence
  ORF2 (NphB) recombinant mutant Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 443 - DNA, 927 bp, Artificial Sequence
  ORF2 (NphB) recombinant mutant Q295G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttggtcgtggcctgctgaaagcgtttgactctttggaagattaatga

SEQ ID NO: 444 - DNA, 927 bp, Artificial Sequence
  ORF2 (NphB) recombinant mutant Q295H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcatcgtggcctgctgaaagcgtttgactctttggaagattaatga

SEQ ID NO: 445 - DNA, 927 bp, Artificial Sequence
  ORF2 (NphB) recombinant mutant Q295I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttattcgtggcctgctgaaagcgtttgactctttggaagattaatga

SEQ ID NO: 446 - DNA, 927 bp, Artificial Sequence
  ORF2 (NphB) recombinant mutant Q295K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaaacgtggcctgctgaaagcgtttgactctttggaagattaatga

SEQ ID NO: 447 - DNA, 927 bp, Artificial Sequence
  ORF2 (NphB) recombinant mutant Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 448 - DNA, 927 bp, Artificial Sequence
  ORF2 (NphB) recombinant mutant Q295M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttatgcgtggcctgctgaaagcgtttgactctttggaagattaatga

SEQ ID NO: 449 - DNA, 927 bp, Artificial Sequence
  ORF2 (NphB) recombinant mutant Q295N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttaatcgtggcctgctgaaagcgtttgactctttggaagattaatga

SEQ ID NO: 450 - DNA, 927 bp, Artificial Sequence
  ORF2 (NphB) recombinant mutant Q295P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttccgcgtggcctgctgaaagcgtttgactctttggaagattaatga

SEQ ID NO: 451 - DNA, 927 bp, Artificial Sequence
  ORF2 (NphB) recombinant mutant Q295Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcagcgtggcctgctgaaagcgtttgactctttggaagattaatga

SEQ ID NO: 452 - DNA, 927 bp, Artificial Sequence
  ORF2 (NphB) recombinant mutant Q295R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcgtcgtggcctgctgaaagcgtttgactctttggaagattaatga

SEQ ID NO: 453 - DNA, 927 bp, Artificial Sequence
  ORF2 (NphB) recombinant mutant Q295S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttagccgtggcctgctgaaagcgtttgactctttggaagattaatga

SEQ ID NO: 454 - DNA, 927 bp, Artificial Sequence
  ORF2 (NphB) recombinant mutant Q295T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttacccgtggcctgctgaaagcgtttgactctttggaagattaatga

SEQ ID NO: 455 - DNA, 927 bp, Artificial Sequence
  ORF2 (NphB) recombinant mutant Q295V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgttcgtggcctgctgaaagcgtttgactctttggaagattaatga

SEQ ID NO: 456 - DNA, 927 bp, Artificial Sequence
  ORF2 (NphB) recombinant mutant Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 457 - DNA, 927 bp, Artificial Sequence
  ORF2 (NphB) recombinant mutant Q295Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttatcgtggcctgctgaaagcgtttgactctttggaagattaatga

SEQ ID NO: 458 - DNA, 927 bp, Artificial Sequence
  ORF2 (NphB) recombinant mutant S214A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgcagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 459 - DNA, 927 bp, Artificial Sequence
  ORF2 (NphB) recombinant mutant S214C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 460 - DNA, 927 bp, Artificial Sequence
  ORF2 (NphB) recombinant mutant S214D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 461 - DNA, 927 bp, Artificial Sequence
  ORF2 (NphB) recombinant mutant S214E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgaagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 462 - DNA, 927 bp, Artificial Sequence
  ORF2 (NphB) recombinant mutant S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttttgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 463 - DNA, 927 bp, Artificial Sequence
  ORF2 (NphB) recombinant mutant S214G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttggtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 464 - DNA, 927 bp, Artificial Sequence
  ORF2 (NphB) recombinant mutant S214H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 465 - DNA, 927 bp, Artificial Sequence
  ORF2 (NphB) recombinant mutant S214I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttattgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 466 - DNA, 927 bp, Artificial Sequence
  ORF2 (NphB) recombinant mutant S214K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaaagtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 467 - DNA, 927 bp, Artificial Sequence
  ORF2 (NphB) recombinant mutant S214L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttctggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 468 - DNA, 927 bp, Artificial Sequence
  ORF2 (NphB) recombinant mutant S214M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttatggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 469 - DNA, 927 bp, Artificial Sequence
  ORF2 (NphB) recombinant mutant S214N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 470 - DNA, 927 bp, Artificial Sequence
  ORF2 (NphB) recombinant mutant S214P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttccggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 471 - DNA, 927 bp, Artificial Sequence
  ORF2 (NphB) recombinant mutant S214Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcaggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 472 - DNA, 927 bp, Artificial Sequence
  ORF2 (NphB) recombinant mutant S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 473 - DNA, 927 bp, Artificial Sequence; identical to SEQ ID NO: 301
  ORF2 (NphB) recombinant mutant S214S

SEQ ID NO: 474 - DNA, 927 bp, Artificial Sequence
  ORF2 (NphB) recombinant mutant S214T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttaccgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 475 - DNA, 927 bp, Artificial Sequence
  ORF2 (NphB) recombinant mutant S214V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttgttgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 476 - DNA, 927 bp, Artificial Sequence
  ORF2 (NphB) recombinant mutant S214W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttgggtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 477 - DNA, 927 bp, Artificial Sequence
  ORF2 (NphB) recombinant mutant S214Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagcttttatgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 478 - DNA, 927 bp, Artificial Sequence
  ORF2 (NphB) recombinant mutant A53A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggcaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 479 - DNA, 927 bp, Artificial Sequence
  ORF2 (NphB) recombinant mutant A53C
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtgtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 480 - DNA, 927 bp, Artificial Sequence
  ORF2 (NphB) recombinant mutant A53D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 481 - DNA, 927 bp, Artificial Sequence
  ORF2 (NphB) recombinant mutant A53E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggaaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 482 - DNA, 927 bp, Artificial Sequence
  ORF2 (NphB) recombinant mutant A53F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtttagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 483 - DNA, 927 bp, Artificial Sequence
  ORF2 (NphB) recombinant mutant A53G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgggtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 484 - DNA, 927 bp, Artificial Sequence
  ORF2 (NphB) recombinant mutant A53H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 485 - DNA, 927 bp, Artificial Sequence
  ORF2 (NphB) recombinant mutant A53I
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgattagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 486 - DNA, 927 bp, Artificial Sequence
  ORF2 (NphB) recombinant mutant A53K
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaaaagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 487 - DNA, 927 bp, Artificial Sequence
  ORF2 (NphB) recombinant mutant A53L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgctgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 488 - DNA, 927 bp, Artificial Sequence
  ORF2 (NphB) recombinant mutant A53M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgatgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 489 - DNA, 927 bp, Artificial Sequence
  ORF2 (NphB) recombinant mutant A53N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 490 - DNA, 927 bp, Artificial Sequence
  ORF2 (NphB) recombinant mutant A53P
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgccgagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 491 - DNA, 927 bp, Artificial Sequence
  ORF2 (NphB) recombinant mutant A53Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 492 - DNA, 927 bp, Artificial Sequence
  ORF2 (NphB) recombinant mutant A53R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcgtagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 493 - DNA, 927 bp, Artificial Sequence
  ORF2 (NphB) recombinant mutant A53S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgagcagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 494 - DNA, 927 bp, Artificial Sequence
  ORF2 (NphB) recombinant mutant A53T
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 495 - DNA, 927 bp, Artificial Sequence
  ORF2 (NphB) recombinant mutant A53V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggttagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 496 - DNA, 927 bp, Artificial Sequence
  ORF2 (NphB) recombinant mutant A53W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtggagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 497 - DNA, 927 bp, Artificial Sequence
  ORF2 (NphB) recombinant mutant A53Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgtatagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 498 - DNA, 927 bp, Artificial Sequence
  ORF2 (NphB) recombinant mutant V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 499 - DNA, 927 bp, Artificial Sequence
  ORF2 (NphB) recombinant mutant L219F, V294N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 500 - DNA, 927 bp, Artificial Sequence
  ORF2 (NphB) recombinant mutant L219F, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 501 - DNA, 927 bp, Artificial Sequence
  ORF2 (NphB) recombinant mutant V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcgcgtggcctgctgaaagcgtttgactctttggaagattaatga

SEQ ID NO: 502 - DNA, 927 bp, Artificial Sequence
  ORF2 (NphB) recombinant mutant L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 503 - DNA, 927 bp, Artificial Sequence
  ORF2 (NphB) recombinant mutant V49A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 504 - DNA, 927 bp, Artificial Sequence
  ORF2 (NphB) recombinant mutant V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 505 - DNA, 927 bp, Artificial Sequence
  ORF2 (NphB) recombinant mutant V49A, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 506 - DNA, 927 bp, Artificial Sequence
  ORF2 (NphB) recombinant mutant Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 507 - DNA, 927 bp, Artificial Sequence
  ORF2 (NphB) recombinant mutant V49A, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 508 - DNA, 927 bp, Artificial Sequence
  ORF2 (NphB) recombinant mutant S177Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 509 - DNA, 927 bp, Artificial Sequence
  ORF2 (NphB) recombinant mutant Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 510 - DNA, 927 bp, Artificial Sequence
  ORF2 (NphB) recombinant mutant A53Q, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 511 - DNA, 927 bp, Artificial Sequence
  ORF2 (NphB) recombinant mutant S177Y, Y288H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgcactaccacattaccgacgttcaacgtggcctgctgaaagcgtttgactctttggaagattaatga

SEQ ID NO: 512 - DNA, 927 bp, Artificial Sequence
  ORF2 (NphB) recombinant mutant A53Q, S177Y
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctacgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 513 - DNA, 927 bp, Artificial Sequence
  ORF2 (NphB) recombinant mutant D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 514 - DNA, 927 bp, Artificial Sequence
  ORF2 (NphB) recombinant mutant A53T, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 515 - DNA, 927 bp, Artificial Sequence
  ORF2 (NphB) recombinant mutant D166E, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 516 - DNA, 927 bp, Artificial Sequence
  ORF2 (NphB) recombinant mutant A53T D166E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 517 - DNA, 927 bp, Artificial Sequence
  ORF2 (NphB) recombinant mutant F123H
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 518 - DNA, 927 bp, Artificial Sequence
  ORF2 (NphB) recombinant mutant L174V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 519 - DNA, 927 bp, Artificial Sequence
  ORF2 (NphB) recombinant mutant S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 520 - DNA, 927 bp, Artificial Sequence
  ORF2 (NphB) recombinant mutant F123H, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 521 - DNA, 927 bp, Artificial Sequence
  ORF2 (NphB) recombinant mutant L174V, S177E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcgaggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 522 - DNA, 927 bp, Artificial Sequence
  ORF2 (NphB) recombinant mutant F123H, L174V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctcactttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacgtttatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 523 - DNA, 927 bp, Artificial Sequence
  ORF2 (NphB) recombinant mutant M106E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 524 - DNA, 927 bp, Artificial Sequence
  ORF2 (NphB) recombinant mutant A53T, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 525 - DNA, 927 bp, Artificial Sequence
  ORF2 (NphB) recombinant mutant M106E, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 526 - DNA, 927 bp, Artificial Sequence
  ORF2 (NphB) recombinant mutant A53T, M106E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcgagttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 527 - DNA, 927 bp, Artificial Sequence
  ORF2 (NphB) recombinant mutant Q38G
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 528 - DNA, 927 bp, Artificial Sequence; identical to SEQ ID NO: 513
  ORF2 (NphB) recombinant mutant D166E

SEQ ID NO: 529 - DNA, 927 bp, Artificial Sequence
  ORF2 (NphB) recombinant mutant Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 530 - DNA, 927 bp, Artificial Sequence
  ORF2 (NphB) recombinant mutant Q38G, Q295A
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 531 - DNA, 927 bp, Artificial Sequence
  ORF2 (NphB) recombinant mutant D166E, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcgcgtggcctgctgaaagcgtttgactctttggaagattaatga

SEQ ID NO: 532 - DNA, 927 bp, Artificial Sequence
  ORF2 (NphB) recombinant mutant Q38G, D166E
atgagcgaagcggcggacgtcgaacgtgtttatgcagcgatggaagaagcagccggtttgctgggtgtggcttgtgcgcgtgataagatttatccactgctgagcacttttggtgacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggagtacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 533 - DNA, 927 bp, Artificial Sequence
  ORF2 (NphB) recombinant mutant K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 534 - DNA, 927 bp, Artificial Sequence
  ORF2 (NphB) recombinant mutant S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 535 - DNA, 927 bp, Artificial Sequence
  ORF2 (NphB) recombinant mutant A53T, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 536 - DNA, 927 bp, Artificial Sequence
  ORF2 (NphB) recombinant mutant K118N, S214F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttttcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 537 - DNA, 927 bp, Artificial Sequence
  ORF2 (NphB) recombinant mutant A53T, K118N
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaacaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 538 - DNA, 927 bp, Artificial Sequence
  ORF2 (NphB) recombinant mutant S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 539 - DNA, 927 bp, Artificial Sequence; identical to SEQ ID NO: 502
  ORF2 (NphB) recombinant mutant L219F

SEQ ID NO: 540 - DNA, 927 bp, Artificial Sequence
  ORF2 (NphB) recombinant mutant S177W, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 541 - DNA, 927 bp, Artificial Sequence
  ORF2 (NphB) recombinant mutant A53Q, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 542 - DNA, 927 bp, Artificial Sequence
  ORF2 (NphB) recombinant mutant A53Q, L219F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgcagagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccttcaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 543 - DNA, 927 bp, Artificial Sequence
  ORF2 (NphB) recombinant mutant A108G
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 544 - DNA, 927 bp, Artificial Sequence
  ORF2 (NphB) recombinant mutant G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 545 - DNA, 927 bp, Artificial Sequence
  ORF2 (NphB) recombinant mutant A108G, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 546 - DNA, 927 bp, Artificial Sequence
  ORF2 (NphB) recombinant mutant Q161S, G205M
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgatgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 547 - DNA, 927 bp, Artificial Sequence
  ORF2 (NphB) recombinant mutant A108G, Q161S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcggtattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 548 - DNA, 927 bp, Artificial Sequence
  ORF2 (NphB) recombinant mutant K118Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttccagaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 549 - DNA, 927 bp, Artificial Sequence
  ORF2 (NphB) recombinant mutant M162A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcaggcgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 550 - DNA, 927 bp, Artificial Sequence
  ORF2 (NphB) recombinant mutant Y283L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtacctgaagctgggcgcgtactaccacattaccgacgttcaacgtggcctgctgaaagcgtttgactctttggaagattaatga

SEQ ID NO: 551 - DNA, 927 bp, Artificial Sequence
  ORF2 (NphB) recombinant mutant V271E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggagtacggtctgaccctgagcccgaaagaagagtactataagctgggcgcgtactaccacattaccgacgttcaacgtggcctgctgaaagcgtttgactctttggaagattaatga

SEQ ID NO: 552 - DNA, 927 bp, Artificial Sequence
  ORF2 (NphB) recombinant mutant K119D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaagacacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 553 - DNA, 927 bp, Artificial Sequence
  ORF2 (NphB) recombinant mutant L274V
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtgttaccctgagcccgaaagaagagtactataagctgggcgcgtactaccacattaccgacgttcaacgtggcctgctgaaagcgtttgactctttggaagattaatga

SEQ ID NO: 554 - DNA, 927 bp, Artificial Sequence
  ORF2 (NphB) recombinant mutant A232S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttagcgtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 555 - DNA, 927 bp, Artificial Sequence
  ORF2 (NphB) recombinant mutant Q161A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtggcgatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 556 - DNA, 927 bp, Artificial Sequence
  ORF2 (NphB) recombinant mutant G205L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgctgctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 557 - DNA, 927 bp, Artificial Sequence; identical to SEQ ID NO: 463
  ORF2 (NphB) recombinant mutant S214G

SEQ ID NO: 558 - DNA, 927 bp, Artificial Sequence
  ORF2 (NphB) recombinant mutant Y216A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgttgcgccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 559 - DNA, 927 bp, Artificial Sequence
  ORF2 (NphB) recombinant mutant N173D
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtagacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 560 - DNA, 927 bp, Artificial Sequence
  ORF2 (NphB) recombinant mutant F123W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgcttggtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 561 - DNA, 927 bp, Artificial Sequence; identical to SEQ ID NO: 533
  ORF2 (NphB) recombinant mutant K118N

SEQ ID NO: 562 - DNA, 927 bp, Artificial Sequence
  ORF2 (NphB) recombinant mutant R228Q
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 563 - DNA, 927 bp, Artificial Sequence; identical to SEQ ID NO: 436
  ORF2 (NphB) recombinant mutant Q161W

SEQ ID NO: 564 - DNA, 927 bp, Artificial Sequence
  ORF2 (NphB) recombinant mutant V294F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacttccaacgtggcctgctgaaagcgtttgactctttggaagattaatga

SEQ ID NO: 565 - DNA, 927 bp, Artificial Sequence; identical to SEQ ID NO: 472
  ORF2 (NphB) recombinant mutant S214R

SEQ ID NO: 566 - DNA, 927 bp, Artificial Sequence
  ORF2 (NphB) recombinant mutant G286E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctggaggcgtactaccacattaccgacgttcaacgtggcctgctgaaagcgtttgactctttggaagattaatga

SEQ ID NO: 567 - DNA, 927 bp, Artificial Sequence
  ORF2 (NphB) recombinant mutant R228E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgacgagctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 568 - DNA, 927 bp, Artificial Sequence
  ORF2 (NphB) recombinant mutant C230S
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgagctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 569 - DNA, 927 bp, Artificial Sequence
  ORF2 (NphB) recombinant mutant D227E
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgagcgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 570 - DNA, 927 bp, Artificial Sequence
  ORF2 (NphB) recombinant mutant M162F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagttcaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 571 - DNA, 927 bp, Artificial Sequence
  ORF2 (NphB) recombinant mutant F123A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctgcgtttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 572 - DNA, 927 bp, Artificial Sequence
  ORF2 (NphB) recombinant mutant A53T, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 573 - DNA, 927 bp, Artificial Sequence
  ORF2 (NphB) recombinant mutant A53T, Q161S, V294A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgcaacgtggcctgctgaaagcgtttgactctttggaagattaatga

SEQ ID NO: 574 - DNA, 927 bp, Artificial Sequence
  ORF2 (NphB) recombinant mutant A53T, Q161S, V294Nqq
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaaccaacgtggcctgctgaaagcgtttgactctttggaagattaatga

SEQ ID NO: 575 - DNA, 927 bp, Artificial Sequence
  ORF2 (NphB) recombinant mutant A53T, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 576 - DNA, 927 bp, Artificial Sequence
  ORF2 (NphB) recombinant mutant Q161S, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 577 - DNA, 927 bp, Artificial Sequence
  ORF2 (NphB) recombinant mutant A53T, Q161S, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 578 - DNA, 927 bp, Artificial Sequence
  ORF2 (NphB) recombinant mutant A53T, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 579 - DNA, 927 bp, Artificial Sequence
  ORF2 (NphB) recombinant mutant A53T, Q161S, V294A, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcggcacgtggcctgctgaaagcgtttgactctttggaagattaatga

SEQ ID NO: 580 - DNA, 927 bp, Artificial Sequence
  ORF2 (NphB) recombinant mutant A53T, Q161S, V294N, Q295A
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaacgcacgtggcctgctgaaagcgtttgactctttggaagattaatga

SEQ ID NO: 581 - DNA, 927 bp, Artificial Sequence; identical to SEQ ID NO: 514
  ORF2 (NphB) recombinant mutant A53T, Q295W

SEQ ID NO: 582 - DNA, 927 bp, Artificial Sequence
  ORF2 (NphB) recombinant mutant Q161S, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 583 - DNA, 927 bp, Artificial Sequence
  ORF2 (NphB) recombinant mutant A53T, Q161S, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttggcgtggcctgctgaaagcgtttgactctttggaagattaatga

SEQ ID NO: 584 - DNA, 927 bp, Artificial Sequence
  ORF2 (NphB) recombinant mutant A53T, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 585 - DNA, 927 bp, Artificial Sequence
  ORF2 (NphB) recombinant mutant A53T, Q161S, V294A, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgcgtggcgtggcctgctgaaagcgtttgactctttggaagattaatga

SEQ ID NO: 586 - DNA, 927 bp, Artificial Sequence
  ORF2 (NphB) recombinant mutant A53T, Q161S, V294N, Q295W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacaactggcgtggcctgctgaaagcgtttgactctttggaagattaatga

SEQ ID NO: 587 - DNA, 927 bp, Artificial Sequence
  ORF2 (NphB) recombinant mutant S177W, Q295
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttgcacgtggcctgctgaaagcgtttgactctttggaagattaatga

SEQ ID NO: 588 - DNA, 927 bp, Artificial Sequence
  ORF2 (NphB) recombinant mutant S177W, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 589 - DNA, 927 bp, Artificial Sequence
  ORF2 (NphB) recombinant mutant Q161S, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 590 - DNA, 927 bp, Artificial Sequence
  ORF2 (NphB) recombinant mutant A53T, S177W
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttctgggagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 591 - DNA, 927 bp, Artificial Sequence
  ORF2 (NphB) recombinant mutant V49A, Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 592 - DNA, 927 bp, Artificial Sequence
  ORF2 (NphB) recombinant mutant V49A, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgcgtttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 593 - DNA, 927 bp, Artificial Sequence
  ORF2 (NphB) recombinant mutant A53T, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 594 - DNA, 927 bp, Artificial Sequence
  ORF2 (NphB) recombinant mutant A53T, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatgaccagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 595 - DNA, 927 bp, Artificial Sequence; identical to SEQ ID NO: 524
  ORF2 (NphB) recombinant mutant A53T, A161S

SEQ ID NO: 596 - DNA, 927 bp, Artificial Sequence
  ORF2 (NphB) recombinant mutant Q161S, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 597 - DNA, 927 bp, Artificial Sequence
  ORF2 (NphB) recombinant mutant Q161S, Q295L
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttagcgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttctgcgtggcctgctgaaagcgtttgactctttggaagattaatga

SEQ ID NO: 598 - DNA, 927 bp, Artificial Sequence
  ORF2 (NphB) recombinant mutant Q161S, S214R
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgagcatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgttcaacgtggcctgctgaaagcgtttgactctttggaagattaatga

SEQ ID NO: 599 - DNA, 927 bp, Artificial Sequence
  ORF2 (NphB) recombinant mutant S214R, Q295F
atgagcgaagcggcggacgtcgaacgtgtttatgcagcgatggaagaagcagccggtttgctgggtgtggcttgtgcgcgtgataagatttatccactgctgagcacttttcaagacacgctggtcgagggtggctcggtggtcgtttttagcatggctagcggtcgccacagcaccgagctggacttctccatctccgtcccgaccagccacggtgatccttacgccaccgttgtggagaaaggtctgttcccggcgaccggccacccggtcgacgatctgctggccgacacgcaaaagcatctgccggtgagcatgttcgcaattgatggtgaggtcacgggcggtttcaaaaagacctatgctttctttccgaccgacaatatgcctggcgttgcggagctgagcgcgatcccgtctatgccgccagcggtggccgagaatgcagagctgttcgctcgttacggtctggataaggtgcagatgaccagcatggattacaagaaacgccaggtaaacctgtatttcagcgagctgtctgcacagacgctcgaagcggagtccgttttggcactggtgcgtgagttgggtctgcacgttccgaatgaattgggtctgaaattctgcaagcgtagctttcgtgtttacccgaccctgaactgggaaaccggcaagattgaccgcctgtgctttgcggtgatcagcaacgatccgacgctggttccgagcagcgatgaaggcgacatcgagaaatttcataactatgcaactaaagcgccgtacgcctatgtcggtgagaagcgcacgctggtgtacggtctgaccctgagcccgaaagaagagtactataagctgggcgcgtactaccacattaccgacgtttttcgtggcctgctgaaagcgtttgactctttggaagattaatga

SEQ ID NO: 600 - DNA, 927 bp, Artificial Sequence; identical to SEQ ID NO: 507
  ORF2 (NphB) recombinant mutant V49A, Q161S

The invention claimed is:

1. A recombinant polypeptide comprising an amino acid sequence with at least 95% identity to SEQ ID NO: 1, wherein said amino acid sequence comprises an amino acid substitution to SEQ ID NO: 1 selected from the group consisting of Q161H, Q161Y, Q161R, Q161F, Q161L, Q161S, Q161T, Q161I, Q161M, Q295, S214, and Y288, wherein said recombinant polypeptide converts olivetolic acid (OA) and geranyl diphosphate (GPP) to cannabigerolic acid (CBGA) and 5-geranyl olivetolate (5-GOA), and wherein said recombinant polypeptide has a CBGA production potential that is higher than wild-type ORF2 enzyme under the same condition.

2. The recombinant polypeptide of claim 1, wherein said amino acid substitution is selected from the group consisting of Q161Y, Q161R, Q161F, Q161L, Q161S, Q161T, Q161I and Q161M.

3. The recombinant polypeptide of claim 1, wherein said amino acid substitution is selected from the group consisting of Q295F, Q295M, Q295W, Q295L, Q295I, Q295C, Q295G, Q295V, Q295D, Q295H, and Q295A.

4. The recombinant polypeptide of claim 1, wherein said amino acid substitution is selected from the group consisting of S214H, S214Q and S214R.

5. The recombinant polypeptide of claim 1, wherein said amino acid substitution is selected from the group consisting of S214Q and S214R.

6. The recombinant polypeptide of claim 1, wherein said amino acid substitution is selected from the group consisting of Y288L, Y288P, Y288I, Y288A, Y288F, Y288C, Y288M, Y288T, Y288W, Y288S, and Y288G.

7. The recombinant polypeptide of claim 1, wherein said amino acid substitution is selected from the group consisting of Y288L, Y288P, Y288A, Y288F, Y288C, Y288M, Y288T, Y288W, Y288S, and Y288G.

8. The recombinant polypeptide of claim 1, wherein said amino acid sequence comprises two or more amino acid substitutions.

9. The recombinant polypeptide of claim 8, wherein said two or more amino acid substitutions are selected from the group consisting of: A53T and S214R; S177W and Q295A; S214R and Q295F; Q161S and S214R; S177W and S214R; Q161S and Q295L; Q161S and Q295F; V49A and S214R; A53T and Q295F; Q161S and S177W; Q161S, V294A and Q295W; A53T, Q161S and Q295W; A53T and S177W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A.

10. The recombinant polypeptide of claim 1, wherein said CBGA production potential is 10%, 20%, 30%, 40%, 50%, 60%, 70%, 80%, 90%, 100%, 150%, or 200% higher than wild-type ORF2 enzyme under the same condition.

11. The recombinant polypeptide of claim 3, wherein said amino acid sequence comprises two or more amino acid substitutions.

12. The recombinant polypeptide of claim 11, wherein said two or more amino acid substitutions are selected from the group consisting of: S177W and Q295A; S214R and Q295F; Q161S and Q295L; Q161S and Q295F; A53T and Q295F; Q161S, V294A and Q295W; A53T, Q161S and Q295W; A53T, Q161S, V294A and Q295W; A53T, V294A and Q295A; V49A and Q295L; A53T, Q161S, V294N and Q295W; A53T and Q295A; Q161S, V294A and Q295A; A53T and Q295W; A53T, V294A and Q295W; A53T, Q161S and Q295A; A53T, Q161S, V294A and Q295A; and A53T, Q161S, V294N and Q295A.

13. The recombinant polypeptide of claim 3, wherein said CBGA production potential is 10%, 20%, 30%, 40%, 50%, 60%, 70%, 80%, 90%, 100%, 150%, or 200% higher than wild-type ORF2 enzyme under the same condition.

14. The recombinant polypeptide of claim 4, wherein said amino acid sequence comprises two or more amino acid substitutions.

15. The recombinant polypeptide of claim 14, wherein said two or more amino acid substitutions are selected from the group consisting of: A53T and S214R; S214R and Q295F; Q161S and S214R; S177W and S214R; and V49A and S214R.

16. The recombinant polypeptide of claim 4, wherein said CBGA production potential is 10%, 20%, 30%, 40%, 50%, 60%, 70%, 80%, 90%, 100%, 150%, or 200% higher than wild-type ORF2 enzyme under the same condition.

17. The recombinant polypeptide of claim 6, wherein said amino acid sequence comprises two or more amino acid substitutions.

18. The recombinant polypeptide of claim 6, wherein said CBGA production potential is 10%, 20%, 30%, 40%, 50%, 60%, 70%, 80%, 90%, 100%, 150%, or 200% higher than wild-type ORF2 enzyme under the same condition.

19. A method of producing a prenylation product, comprising: contacting said recombinant polypeptide of claim 1 with a substrate and a donor, thereby producing said prenylation product.

20. The method of claim 19, wherein said substrate comprises olivetolic acid (OA) and said donor comprises geranyl pyrophosphate (GPP), and wherein said prenylation product comprises CBGA, 5-GOA, a prenylated product on any other position on an aromatic ring of said substrate, or any combination thereof.

21. The method of claim 20, wherein said prenylation product comprises CBGA and 5-GOA, and wherein said recombinant polypeptide produces a ratio of an amount of CBGA to a combined amount of CBGA and 5-GOA that is higher than wild-type ORF2 enzyme under the same acid condition.

22. The method of claim 20, wherein said prenylation product comprises CBGA and 5-GOA, and wherein said recombinant polypeptide produces a combined amount of CBGA and 5-GOA that is higher than wild-type ORF2 enzyme under the same acid condition.

23. The method of claim 19, wherein said contacting comprises contacting said substrate and said donor with said recombinant polypeptide in a cell.

24. The method of claim 19, wherein said contacting comprises contacting said substrate and said donor with said recombinant polypeptide in a cell-free reaction.

25. The method of claim 19, wherein said contacting comprises contacting said substrate and said donor with said recombinant polypeptide in a reaction, wherein said recombinant polypeptide is secreted by a cell into a media before the contacting.

26. A cell, comprising a cell vector, a construct or an expression system comprising a nucleic acid molecule encoding the recombinant polypeptide of claim 1, or a codon degenerate nucleotide sequence thereof.

\* \* \* \* \*